US012807665B2

(12) United States Patent
Xiao et al.

(10) Patent No.: US 12,807,665 B2
(45) Date of Patent: Nov. 24, 2026

(54) MODIFIED CELL EXPANSION AND USES THEREOF

(71) Applicant: Innovative Cellular Therapeutics, Inc., Rockville, MD (US)

(72) Inventors: Lei Xiao, Rockville, MD (US); Chengfei Pu, Shanghai (CN); Zhiyuan Cao, Shanghai (CN)

(73) Assignees: Innovative Cellular Therapeutics Holdings, Ltd., George Town (KY); Innovative Cellular Therapeutics, Inc., Rockville, MD (US)

( * ) Notice: Subject to any disclaimer, the term of this patent is extended or adjusted under 35 U.S.C. 154(b) by 1269 days.

(21) Appl. No.: 17/420,066

(22) PCT Filed: Jan. 10, 2020

(86) PCT No.: PCT/US2020/013099
§ 371 (c)(1),
(2) Date: Jun. 30, 2021

(87) PCT Pub. No.: WO2020/146743
PCT Pub. Date: Jul. 16, 2020

(65) Prior Publication Data

US 2022/0096546 A1 Mar. 31, 2022

Related U.S. Application Data

(63) Continuation-in-part of application No. 16/445,965, filed on Jun. 19, 2019, now Pat. No. 10,918,667, and a continuation-in-part of application No. 16/387,166, filed on Apr. 17, 2019, now Pat. No. 10,869,888.

(60) Provisional application No. 62/932,587, filed on Nov. 8, 2019, provisional application No. 62/902,766, filed on Sep. 19, 2019, provisional application No. 62/891,131, filed on Aug. 23, 2019, provisional application No. 62/889,926, filed on Aug. 21, 2019, provisional application No. 62/848,961, filed on May 16, 2019, provisional application No. 62/846,563, filed on May 10, 2019, provisional application No. 62/817,322, filed on Mar. 12, 2019, provisional application No. 62/816,497, filed on Mar. 11, 2019, provisional application No. 62/799,462, filed on Jan. 31, 2019, provisional application No. 62/790,783, filed on Jan. 10, 2019.

(51) Int. Cl.

| | |
|---|---|
| ***C07K 14/54*** | (2006.01) |
| ***A61K 40/11*** | (2025.01) |
| ***A61K 40/31*** | (2025.01) |
| ***A61K 40/42*** | (2025.01) |
| ***C07K 14/57*** | (2006.01) |
| ***C07K 14/705*** | (2006.01) |
| ***C07K 16/28*** | (2006.01) |
| ***C12N 5/0781*** | (2010.01) |
| ***C12N 5/0783*** | (2010.01) |
| *A61K 39/00* | (2006.01) |

(52) U.S. Cl.
CPC .......... *C07K 14/5412* (2013.01); *A61K 40/11* (2025.01); *A61K 40/31* (2025.01); *A61K 40/4211* (2025.01); *A61K 40/4237* (2025.01); *A61K 40/4257* (2025.01); *A61K 40/4265* (2025.01); *A61K 40/4269* (2025.01); *C07K 14/57* (2013.01); *C07K 14/7051* (2013.01); *C07K 14/70521* (2013.01); *C07K 14/70578* (2013.01); *C07K 16/2803* (2013.01); *C12N 5/0635* (2013.01); *C12N 5/0636* (2013.01); *A61K 2039/505* (2013.01); *A61K 2239/30* (2023.05); *A61K 2239/50* (2023.05); *C07K 2317/622* (2013.01); *C07K 2319/02* (2013.01); *C07K 2319/03* (2013.01); *C07K 2319/30* (2013.01); *C07K 2319/33* (2013.01)

(58) Field of Classification Search
None
See application file for complete search history.

(56) References Cited

U.S. PATENT DOCUMENTS 9,388,237 B2 7/2016 Govindan
9,572,837 B2 2/2017 Wu
(Continued)

FOREIGN PATENT DOCUMENTS

EP 2508176 A1 10/2012
JP 2016500659 A1 1/2016
(Continued)

OTHER PUBLICATIONS

Finney et al (Journal of Clinical Investigation (129(5):2123-2132).*
(Continued)

*Primary Examiner* — Brad Duffy
(74) *Attorney, Agent, or Firm* — Lee & Hayes, P.C.

(57) ABSTRACT

The present disclosure relates to compositions and methods for enhancing T cell response and/or CAR cell expansion and/or maintenance in vivo and/or in vitro. For example, a method of enhancing T cell-based therapy comprises administering a mixed population of T cells comprising modified T cells comprising a first chimeric antigen receptor (CAR) and modified T cells comprising a second CAR, wherein a binding domain of the first CAR binds a first antigen, and a binding domain of the second CAR binds a second antigen. The first antigen is different from the second antigen. In embodiments, the first CAR binds a surface molecule or antigen of a white blood cell.

31 Claims, 92 Drawing Sheets

Specification includes a Sequence Listing.

(56) References Cited

U.S. PATENT DOCUMENTS

| | | | |
|---|---|---|---|
| 9,932,405 B2 | 4/2018 | Xiao et al. | |
| 10,561,686 B2 | 2/2020 | Xiao et al. | |
| 10,869,888 B2 | 12/2020 | Xiao et al. | |
| 2002/0052027 A1 | 5/2002 | Chen et al. | |
| 2002/0192183 A1 | 12/2002 | Jensen | |
| 2005/0079170 A1 | 4/2005 | Le Gall et al. | |
| 2011/0110936 A1 | 5/2011 | Nam et al. | |
| 2013/0108609 A1 | 5/2013 | Vihko | |
| 2013/0287748 A1 | 10/2013 | June et al. | |
| 2014/0050708 A1 | 2/2014 | Powell et al. | |
| 2014/0227237 A1 | 8/2014 | June et al. | |
| 2014/0248278 A1 | 9/2014 | Tuscano et al. | |
| 2014/0271635 A1 | 9/2014 | Brogdon et al. | |
| 2015/0037356 A1 | 2/2015 | Elvin et al. | |
| 2015/0038684 A1 | 2/2015 | Jensen | |
| 2015/0329640 A1* | 11/2015 | Finer | C07K 14/70514 435/328 |
| 2015/0337369 A1 | 11/2015 | Davis et al. | |
| 2016/0008398 A1 | 1/2016 | Sadelain et al. | |
| 2016/0024175 A1 | 1/2016 | Chow et al. | |
| 2016/0250258 A1 | 9/2016 | Delaney et al. | |
| 2016/0256488 A1 | 9/2016 | Wu | |
| 2016/0289293 A1 | 10/2016 | Pule et al. | |
| 2016/0362472 A1 | 12/2016 | Bitter et al. | |
| 2017/0015746 A1 | 1/2017 | Jensen | |
| 2017/0096638 A1 | 4/2017 | Wu | |
| 2017/0136063 A1 | 5/2017 | Perez et al. | |
| 2017/0137783 A1 | 5/2017 | Bedoya et al. | |
| 2017/0145094 A1 | 5/2017 | Galetto | |
| 2017/0145108 A1 | 5/2017 | Schreiber et al. | |
| 2017/0209492 A1 | 7/2017 | June et al. | |
| 2017/0218337 A1 | 8/2017 | Friedman | |
| 2017/0224798 A1 | 8/2017 | Cooper et al. | |
| 2017/0319638 A1 | 11/2017 | Conner et al. | |
| 2017/0335281 A1 | 11/2017 | Loew et al. | |
| 2017/0355776 A1* | 12/2017 | Xiao | C07K 14/4748 |
| 2017/0362325 A1 | 12/2017 | Jung et al. | |
| 2017/0368098 A1 | 12/2017 | Chen et al. | |
| 2018/0028631 A1 | 2/2018 | Chen | |
| 2018/0044424 A1 | 2/2018 | June et al. | |
| 2018/0153977 A1* | 6/2018 | Wu | A61K 40/11 |
| 2018/0179289 A1 | 6/2018 | Xiao et al. | |
| 2018/0222995 A1 | 8/2018 | Xiao et al. | |
| 2018/0223255 A1 | 8/2018 | Wu et al. | |
| 2018/0230429 A1 | 8/2018 | Baeuerle et al. | |
| 2018/0243340 A1 | 8/2018 | Varadarajan et al. | |
| 2018/0334490 A1 | 11/2018 | Brogdon et al. | |
| 2018/0346876 A1 | 12/2018 | Xiao et al. | |
| 2019/0000878 A1 | 1/2019 | Xiao et al. | |
| 2019/0185817 A1 | 6/2019 | Melton et al. | |
| 2019/0216851 A1 | 7/2019 | Xiao et al. | |
| 2019/0314410 A1 | 10/2019 | Rossi et al. | |
| 2019/0314411 A1 | 10/2019 | Xiao et al. | |
| 2020/0155598 A1 | 5/2020 | Xiao et al. | |
| 2021/0060069 A1 | 3/2021 | Xiao et al. | |
| 2021/0077532 A1 | 3/2021 | Xiao et al. | |
| 2021/0100841 A1 | 4/2021 | Xiao et al. | |
| 2021/0137983 A1 | 5/2021 | Xiao et al. | |
| 2021/0161961 A1 | 6/2021 | Xiao et al. | |
| 2021/0230308 A1 | 7/2021 | Xiao et al. | |
| 2021/0252059 A1 | 8/2021 | Pu et al. | |
| 2021/0379149 A1 | 12/2021 | Pu et al. | |
| 2022/0000921 A1 | 1/2022 | Xiao et al. | |
| 2022/0056092 A1 | 2/2022 | Ols et al. | |
| 2022/0064599 A1 | 3/2022 | Spanholtz et al. | |
| 2022/0105134 A1 | 4/2022 | Cao et al. | |
| 2022/0195009 A1 | 6/2022 | Arnold et al. | |
| 2022/0339193 A1 | 10/2022 | Xiao et al. | |
| 2022/0348682 A1 | 11/2022 | Xiao et al. | |
| 2023/0312677 A1 | 10/2023 | Posey et al. | |

FOREIGN PATENT DOCUMENTS

| | | | |
|---|---|---|---|
| JP | 2018508539 | A | 3/2018 |
| JP | 2018518939 | A | 7/2018 |
| JP | 2018528774 | A | 10/2018 |
| JP | 2021510540 | A | 4/2021 |
| JP | 2022507830 | A | 1/2022 |
| NO | 168969 | B | 1/1992 |
| WO | WO8303679 | A1 | 10/1983 |
| WO | WO2001036001 | A2 | 5/2001 |
| WO | WO2008131445 | A1 | 10/2008 |
| WO | WO2010081738 | A1 | 7/2010 |
| WO | WO2010126766 | A1 | 11/2010 |
| WO | WO2011130566 | A2 | 10/2011 |
| WO | WO2012050374 | A1 | 4/2012 |
| WO | WO2012066495 | A2 | 5/2012 |
| WO | WO2012079000 | A1 | 6/2012 |
| WO | WO2013123061 | A1 | 8/2013 |
| WO | WO2014011984 | A1 | 1/2014 |
| WO | WO2014011988 | A2 | 1/2014 |
| WO | WO2014012001 | A2 | 1/2014 |
| WO | WO2014031687 | A1 | 2/2014 |
| WO | WO2014130657 | A1 | 8/2014 |
| WO | WO2014134165 | A1 | 9/2014 |
| WO | WO2015105522 | A1 | 7/2015 |
| WO | WO2015142675 | A2 | 9/2015 |
| WO | WO2015157252 | A1 | 10/2015 |
| WO | WO2015157384 | A1 | 10/2015 |
| WO | WO2015157432 | A1 | 10/2015 |
| WO | WO2015188141 | A2 | 12/2015 |
| WO | WO2016014565 | A2 | 1/2016 |
| WO | WO2016028896 | A1 | 2/2016 |
| WO | WO2016061574 | A1 | 4/2016 |
| WO | WO2016064899 | A1 | 4/2016 |
| WO | WO2016070136 | A1 | 5/2016 |
| WO | WO2016090034 | A2 | 6/2016 |
| WO | WO2016090190 | A1 | 6/2016 |
| WO | WO2016113203 | A1 | 7/2016 |
| WO | WO2016164731 | A2 | 10/2016 |
| WO | WO2016174652 | A1 | 11/2016 |
| WO | WO2016210293 | A1 | 12/2016 |
| WO | WO2017011804 | A1 | 1/2017 |
| WO | WO2017027291 | A1 | 2/2017 |
| WO | WO2017044487 | A1 | 3/2017 |
| WO | WO2017050884 | A1 | 3/2017 |
| WO | WO2017075537 | A1 | 5/2017 |
| WO | WO2017120525 | A1 | 7/2017 |
| WO | WO2017123556 | A1 | 7/2017 |
| WO | WO2017040324 | A1 | 9/2017 |
| WO | WO2017149515 | A1 | 9/2017 |
| WO | WO2017167217 | A1 | 10/2017 |
| WO | WO2017172952 | A1 | 10/2017 |
| WO | WO2017172981 | A1 | 10/2017 |
| WO | WO2017173403 | A1 | 10/2017 |
| WO | WO2017177137 | A1 | 10/2017 |
| WO | WO2017180989 | A2 | 10/2017 |
| WO | WO2017210617 | A2 | 12/2017 |
| WO | WO2018013918 | A1 | 1/2018 |
| WO | WO2018018958 | A1 | 2/2018 |
| WO | WO2018023976 | A1 | 2/2018 |
| WO | WO2018026819 | A2 | 2/2018 |
| WO | WO2018027155 | | 2/2018 |
| WO | WO2018049418 | A1 | 3/2018 |
| WO | WO2018067697 | A1 | 4/2018 |
| WO | WO2018106732 | A1 | 6/2018 |
| WO | WO2018108106 | A1 | 6/2018 |
| WO | WO2018111763 | A1 | 6/2018 |
| WO | WO2018144535 | A1 | 8/2018 |
| WO | WO2018156802 | A1 | 8/2018 |
| WO | WO2018191748 | A1 | 10/2018 |
| WO | WO2018193231 | A1 | 10/2018 |
| WO | WO2019091478 | A1 | 5/2019 |
| WO | WO2019136305 | A1 | 7/2019 |
| WO | WO2019140100 | A1 | 7/2019 |
| WO | WO2019157533 | A1 | 8/2019 |
| WO | WO2019178576 | A1 | 9/2019 |
| WO | WO2020047306 | A1 | 3/2020 |
| WO | WO2020086742 | | 4/2020 |
| WO | WO2020086989 | A1 | 4/2020 |

(56) References Cited

FOREIGN PATENT DOCUMENTS

| | | |
|---|---|---|
| WO | WO2020088631 A1 | 5/2020 |
| WO | WO2020106843 A1 | 5/2020 |
| WO | WO2020108642 A1 | 6/2020 |
| WO | WO2020108643 A1 | 6/2020 |
| WO | WO2020108644 A1 | 6/2020 |
| WO | WO2020108645 A1 | 6/2020 |
| WO | WO2020108646 A1 | 6/2020 |
| WO | WO2020146743 A1 | 7/2020 |

OTHER PUBLICATIONS

Cherkassy et al. (J Clin Invest, 2016, 126 (8):3130-3144).*
Stevenson et al (Cancer Biology, 9:39-147, 1999).*
Almagro et al., "Progress and challenges in the design and clinical development of antibodies for cancer therapy," Frontiers in Immunology, Jan. 2018, 8:1751, 19 pages.
Breloer et al., "CD83 Regulates Lymphocyte Maturation, Activation and Homeostasis," Trends in Immunology, Mar. 2008, 29(4):186-194.
Brown et al., "Tolerance of Single, but Not Multiple, Amino Acid Replacements in Antibody VH CDR 2: A Means of Minimizing B Cell Wastage from Somatic Hypermutation?" Journal of Immunology, May 1996, 156(9):3285-3291.
Brudno et al., "Toxicities of Chimeric Antigen Receptor T Cells: Recognition and Management," Blood, Jun. 2016, 127(26):3321-3330.
Cho et al., "Triple Costimulation via CD80, 4-1BB, and CD83 Ligand Elicits the Long-Term Growth of Vγ9Vδ2 T Cells in Low Levels of IL-2," Journal of Leukocyte Biology, Apr. 2016, 99(4):521-529.
Du et al., "Granulocyte Colony-Stimulating Factor Treatment During Radiotherapy Is Associated With Survival Benefit in Patients With Lung Cancer," Technology in Cancer Research & Treatment, Dec. 2018, 17:1-7.
European Office Action mailed Feb. 5, 2024 for European Application No. 19854895.0, a foreign counterpart to U.S. Appl. No. 17/270,571, 6 pages.
Japanese Office Action mailed Jan. 30, 2024 for Japanese Application No. 2021-540137, a foreign counterpart to U.S. Appl. No. 17/420,066, 7 pages.
Konjevic et al., "The Role of Cytokines in the Regulation of NK Cells in the Tumor Environment," Cytokine, May 2019, 117:30-40.
Li et al., "CD83: Activation Marker for Antigen Presenting Cells and Its Therapeutic Potential," Frontiers in Immunology, Jun. 2019, 10:Article 1312, 9 pages.
Ping et al., "T-cell Receptor-engineered T Cells for Cancer Treatment: Current Status and Future Directions," Protein Cell, Mar. 2018, 9(3):254-266.
Priceman et al., "Co-stimulatory Signaling Determines Tumor Antigen Sensitivity and Persistence of Car T Cells Targeting PSCA+ Metastatic Prostate Cancer," Oncolmmunology, Feb. 2018, 7(2):e1380764, 13 pages.
Rabinowich et al., "Response of Human NK Cells to IL-6 Alterations of the Cell Surface Phenotype, Adhesion to Fibronectin and Laminin, and Tumor Necrosis Factor-Alpha/Beta Secretion," Journal of immunology, Jun. 1993, 150(11):4844-4855.
Scheuermann et al., "CD19 Antigen in Leukemia and Lymphoma Diagnosis and Immunotherapy," Leukemia & Lymphoma, 1995, 18(5-6):385-397.
Su et al., "Interleukin-7 Expression and its Effect on Natural Killer Cells in Patients with Multiple Sclerosis," J Neuroimmunol., Nov. 2014, 276(0):180-186.
Zhang et al., "The Emerging World of TCR-T Cell Trials Against Cancer: A Systematic Review," Technology in Cancer Research & Treatment, Jul. 2019, 18:1-13.
European Office Action mailed Mar. 17, 2022 for European Patent Application No. 19700326.2, a foreign counterpart to U.S. Pat. No. 10,561,686, 7 pages.
Partial European Search Report mailed May 4, 2022 for European Patent Application No. 19854895.0, 13 pages.
Japanese office action mailed Apr. 5, 2022 in Japanese Application No. 2021-512204, a foreign corresponding application of U.S. Appl. No. 17/220,387, 10 pages. Translated.
Marks et al., "By-passing Immunization: Human Antibodies from V-gene Libraries Displayed on Phage" 1991. Journal of Molecular Biology, 222(3): 581-597.
Altuntas et al., "Autoimmunity to Uroplakin II Causes Cystitis in Mice: A Novel Model of Interstitial Cystitis," Eur Urol, Jan. 2012, 61(1):193-200.
Auerbach et al., "Angiogenesis Assays: Problems and Pitfalls," Cancer and Metastasis Reviews, Jun. 2000, 19:167-172.
Beans, "Targeting Metastasis to Halt Cancer's Spread," PNAS, Dec. 2018, 115(50):12539-12543.
Canadian Office Action mailed Sep. 14, 2023 for Canadian Application No. 3120153, a foreign corresponding application of U.S. Appl. No. 17/295,364, 4 pages.
Canadian Office Action mailed Sep. 19, 2023 for Canadian Application No. 3110096, a foreign corresponding application of U.S. Appl. No. 17/270,571, 3 pages.
Gravanis et al., "The Changing World of Cancer Drug Development: The Regulatory Bodies' Perspective," Chinese Clinical Oncology, May 2014, 3(2):22, 5 pages.
Gura, "Systems for Identifying New Drugs Are Often Faulty," Science, Nov. 1997, 278(5340):1041-1042.
Hait, "Anticancer Drug Development: The Grand Challenges," Nature Reviews/Drug Discovery, Apr. 2010, 9:253-254.
Heppner et al., "Tumor Heterogeneity: Biological Implications and Therapeutic Consequences," Cancer Metastasis Review 1983, 2:5-23.
Hoang et al, "A Newly Developed Uroplakin II Antibody With Increased Sensitivity in Urothelial Carcinoma of the Bladder," Arch Pathol Lab Med, Jul. 2014, 138:943-949.
Jain, "Barriers to Drug Delivery in Solid Tumors," Scientific American, Jul. 1994, 271(1):58-65.
Japanese Office Action mailed Oct. 17, 2023 for Japanese Application No. 2021-527959, a foreign corresponding application of U.S. Appl. No. 17/295,364, 6 pages.
Japanese Office Action mailed Oct. 31, 2023 for Japanese Application No. 2022-154638, aa foreign corresponding application of U.S. Appl. No. 17/270,571, 6 pages.
Liou et al., "Macrophage-secreted Cytokines Drive Pancreatic Acinar-to-ductal Metaplasia Through NF-KB and MMPs," Journal of Cell Biology, 2013, 202(3):563-577.
Mishu et al., "Effects of Recombinant Canine Granulocyte Colony-stimulating Factor on White Blood Cell Production in Clinically Normal and Neutropenic Dogs," J Am Vet Med Assoc., Jun. 1992, 200(12), Abstract, 1 page.
Rahman et al., "Histology, Natural Killer Cells," retrieved from <<https://www.ncbi.nlm.nih.gov/books/NBK565844/>>, StatPearls Publishing, Feb. 2023, 6 pages.
Rohaan et al., "Adoptive Cellular Therapies: The Current Landscape," Virchows Archiv, Nov. 2018, 474:449-461.
Snook et al., "GUCY2C-targeted Cancer Immunotherapy: Past, Present and Future," Immunology Research, Dec. 2011, 51:161-169.
Sporn et al., "Chemoprevention of Cancer", Carcinogenesis, Mar. 2000, 21(3):525-530.
Tigner et al., "Histology, White Blood Cell," retrieved from <<https://www.ncbi.nlm.nih.gov/books/NBK563148/>>, StatPearls Publishing, Nov. 2022, 5 pages.
Wu et al., "Potentiating Antilymphoma Efficacy of Chemotherapy Using a Liposome for Integration of CD20 Targeting, Ultra-violet Irradiation Polymerizing, and Controlled Drug Delivery", Nanoscale Research Letters, 2014, 9(447), 11 pages.
Yu et al., "CART Cell Therapy for Prostate Cancer: Status and Promise," OncoTargets and Therapy, 2019, 12:391-395.
Canadian Office Action mailed Oct. 25, 2023 for Canadian Application No. 3,088,161, a foreign counterpart to U.S. Pat. No. 10,561,686, 4 pages.

(56) References Cited

OTHER PUBLICATIONS

Japanese Office Action mailed Jan. 16, 2024 for Japanese Application No. 2020-558861, a foreign counterpart to U.S. Pat. No. 10,561,686, 7 pages.
Anderson, et al. "Obstacles Posed by the Tumor Microenvironment to T Cell Activity: A Case for Synergistic Therapies," Cancer Cell, vol. 31, No. 3, Mar. 2017, pp. 311-325.
Examination Report for Australian Application No. 2019384145, Dated Aug. 5, 2024, 4 pages.
Office Action for European Application No. 21275039.2, Dated May 23, 2024, 7 pages.
Extended European Search Report mailed Jun. 11, 2024 for European Patent Application No. 21792367.1, 13 pages.
Office Action for Japanese Application No. 2021-527959, Dated May 7, 2024, 6 pages.
Office Action for Japanese Application No. 2021-540137, Dated Jul. 30, 2024, 6 pages.
Kim, et al., "High Cleavage Efficiency of a 2A Peptide Derived from Porcine Teschovirus-1 in Human Cell Lines, Zebrafish and Mice", PLoS One, vol. 6, issue 4, Apr. 29, 2011, pp. 1-8.
Koneru, et al., "A Phase I Clinical Trial of Adoptive T Cell Therapy Using IL-12 Secreting MUC-16(Ecto) Directed Chimeric Antigen Receptors for Recurrent Ovarian Cancer," Journal of Translational Medicine, vol. 13, No. 102, Mar. 2015, 11 pages.
Kong, et al., "Emerging Roles of Human Prostatic Acid Phosphatase" Biomolecules & Therapeutics, vol. 21, No. 1, 2013, pp. 10-20.
Lu, et al., "Generation of Murine Induced Pluripotent Stem Cells by Using High-Density Distributed Electrodes Network," Biomicrofluidics, vol. 9, No. 5, Sep. 2015, pp. 054107-1-054107-11.
Oladapo, et al., "Armored CAR T-Cells: Utilizing Cytokines and Pro-Inflammatory Ligands to Enhance CAR T-Cell Anti-Tumour Efficacy," Biochemical Society Transactions, vol. 44, Part 2, Apr. 2016, pp. 412-418.
Yu, et al., "CART Cell Therapy for Prostate Cancer: Status and Promise," OncoTargets and Therapy, vol. 12, 2019, pp. 391-395.
U.S. Appl. No. 16/146,218, filed Sep. 28, 2018, US-2019-0216851-A1, U.S. Pat. No. 10,561,686, Granted.
U.S. Appl. No. 16/961,418, filed Jul. 10, 2020, US 2022-0265708 A1, Pending.
U.S. Appl. No. 16/445,965, filed Jun. 19, 2019, US-2020-0155598-A1, U.S. Pat. No. 10,918,667, Granted.
U.S. Appl. No. 17/144,800, filed Jan. 8, 2021, US 2021-0161961 A1, Pending.
U.S. Appl. No. 17/295,364, filed May 19, 2021, US 2022-0000921 A1, Pending.
U.S. Appl. No. 17/749,824, filed May 20, 2022, US-2022-0339193-A1, Pending.
U.S. Appl. No. 16/387,166, filed Apr. 17, 2019, US 2019-0314411 A1, U.S. Pat. No. 10,869,888, Granted.
U.S. Appl. No. 17/091,741, filed Nov. 6, 2020, US 2021-0137983 A1, Pending.
U.S. Appl. No. 17/108,076, filed Dec. 1, 2020, US 2021-0077532 A1, Pending.
U.S. Appl. No. 17/270,571, filed Feb. 23, 2021, US 2022-0348682 A1, Pending.
U.S. Appl. No. 17/220,387, filed Apr. 1, 2021, US2021-0230308 A1, U.S. Pat. No. 11,161,913, Granted.
U.S. Appl. No. 17/123,732, filed Dec. 16, 2020, Pending.
U.S. Appl. No. 17/173,504, filed Feb. 11, 2021, US 2021-0252059 A1, Pending.
U.S. Appl. No. 17/996,589, filed Oct. 19, 2022, Pending.
U.S. Appl. No. 16/996,237, filed Aug. 18, 2020, US 2021-0060069 A1, Pending.
U.S. Appl. No. 17/331,289, filed May 26, 2021, US 2021-0371492 A1, Pending.
U.S. Appl. No. 16/999,357, filed Aug. 21, 2020, US 2021-0100841 A1, Pending.
Canadian Office Action for Canadian Patent Appl.: 3,088,161, mailed Sep. 22, 2021, a foreign corresponding application of U.S. Appl. No. 16/999,357, 4 pages.
Brischwein et al. "Strictly target cell-dependent activation of T cells by bispecific single-chain antibody constructs of the BiTE class" J Immunother, Nov. 2007, vol. 30, pp. 798-807.
Chmielewski, "Of CARs and TRUCKs: Chimeric antigen receptor (CAR) T Cells Engineered with an Inducible Cytokine to Modulate the Tumor Stroma," Jan. 2014. Imunological Reviews, 257(1): 83-90.
European Search Report mailed Aug. 31, 2021 in European Application No. 21275039.2, a foreign corresponding application of U.S. Appl. No. 16/999,357, 13 pages.
Huang et al., "Interleukin-armed Chimeric Antigen Receptor-modified T Cells for Cancer Immunotherapy," Sep. 2017. Gene Thereapy, 25(3):192-197.
International Preliminary Report on Patentability dated Jul. 22, 2021 in PCT Application No. PCT/US2020/013099, 9 pages.
International Search Report & Written Opinion mailed Aug. 13, 2021 from PCT Application No. PCT/2021/028429, 12 pages.
Lee et al., "Use of a Simgle CAR T Cell and Several Bispecific Adapters Facilitates Eradication of Multiple Antigenically Differerent Solid Tumors," Nov. 2018. Cancer Research, 79(2): 387-396.
Wong et al. "Blinatumomab induces autologous T-cell killing of chronic lymphocytic leukemia cells," Jun. 2013, Haematologica, vol. 98(12): 1930-1938.
Canadian Office Action mailed Sep. 1, 2023 for Canadian Patent Application No. 3,125,646, a foreign counterpart to U.S. Pat. No. 10,869,888, 4 pages.
Canadian Office Action mailed Jul. 20, 2022 for Canadian Patent Application No. 3,088,161, a foreign counterpart to U.S. Pat. No. 10,561,686, 4 pages.
Chmielewski, et al., "IL-12 Release by Engineered T Cells Expressing Chimeric Antigen Receptors Can Effectively Muster and Antigen-Independent Macrophage Response on Tumor Cells That Have Shut Down Tumor Antigen Expression", Cancer Research, Jul. 2011, 71(17):5697-5706.
Extended European Search Report mailed Nov. 14, 2022 for European Application No. 19887928.0, a foreign corresponding application of U.S. Appl. No. 16/445,965, 12 pages.
Extended European Search Report mailed Nov. 24, 2022 for European Patent Application No. 20739064.2, a foreign corresponding application of U.S. Appl. No. 16/387,166, 13 pages.
European Search Report mailed Aug. 4, 2022 in European Application No. 19854895.0, a foreign corresponding application of U.S. Appl. No. 17/270,571, 8 pages.
Hoyos, et al., "Engineering CD19-specific T lymphocytes with interleukin-15 and a suicide gene to enhance their anti-lymphoma/leukemia effects and safety", Leukemia, Apr. 2010, 24(6):1160-1170.
Japanese Office Action mailed Sep. 20, 2022 for Japanese Patent Application No. 2020-558861, a foreign counterpart to U.S. Pat. No. 10,561,686, 7 pages.
Klaver, et al., "Plasma IFN-[gamma] and IL-6 levels correlate with peripheral T-cell numbers but not toxicity in RCC patients treated with CAR T-cells", Clinical Immunology, Jul. 2016, 169:107-113.
Koneru, et al., "IL-12 Secreting tumor-targeted chimeric antigen receptor T cells eradicate ovarian tumors in vivo", Oncoimmunology, Jan. 2015, 4(3):e994446, 11 pages.
Posey et al., "Engineered CAR T Cells Targeting the Cancer-Associated Tn-Glycoform of the Membrane Mucin MUC1 Control Adenocarcinoma", Immunity, Jun. 2016, 44(6):1444-1454.
Leon-Triana, et al., "Dual-Target CAR-Ts with On- and Off-Tumor Activity May Override Immune Suppression in Solid Cancers: A Mathematical Proof of Concept", Cancers, Feb. 2021, 13(4):703, 20 pages.
Trinchieri, "Interleukin-12 and the regulation of innate resistance and adaptive immunity", Nature Reviews Immunology, Feb. 2003, 3(2):133-146.
Ghadially, et al., "Differential Regulation of CCL22 Gene Expression in Murine Dendritic Cells and B Cells", The Journal of Immunology, May 2009, 174(9):5620-5629.
Kim, et al., "Increased IL-12 inhibits B cells' differentiation to germinal center cells and promotes differentiation to short-lived plasmablasts", The Journal of Experimental Medicine, Sep. 2008, 205(10):2437-2448.

(56) References Cited

OTHER PUBLICATIONS

Largeot, et al., "The B-Side of Cancer Immunity: The Underrated Tune", Cells, May 2019, 8(449):1-20.
Bollino et al., "Chimeric Antigen Receptor-Engineered Natural Killer and Natural Killer T Cells for Cancer Immunotherapy," Translational Research, Jun. 2017, 187:32-43.
Bork, P., "Powers and Pitfalls in Sequence Analysis: The 70% Hurdle," Genome Research, 2000, 10:398-400.
Bowie et al., "Deciphering the Message in Protein Sequences: Tolerance to Amino Acid Substitutions," Science, Mar. 1990, 247:1306-1310.
Burgess et al., "Possible Dissociation of the Heparin-binding and Mitogenic Activities of Heparin-binding (Acidic Fibroblast) Growth Factor-1 from its Receptor-binding Activities by Site-directed Mutagenesis of a Single Lysine Residue," J. Cell Biol., Nov. 1990, 111:2129-2138.
Cherkassky et al., "Human CAR T Cells with Cell-intrinsic PD-1 Checkpoint Blockade Resist Tumor-mediated Inhibition," Journal of Clinical Investigation, May 2016, 126(8):3130-3144.
Chmielewski et al., "CAR T Cells Releasing IL-18 Convert to T-Bethigh FoxO1low Effectors that Exhibit Augmented Activity Against Solid Tumors," Cell Reports, Dec. 2017, 21:3205-3219.
Duong et al., "Bacteria-cancer interactions: Bacteria-based Cancer Therapy," Experimental & Molecular Medicine, 2019, 51:152, 15 pages.
Eyquem et al., "Targeting a CAR to the TRAC Locus with CRISPR/Cas9 Enhances Tumour Rejection," Nature, Mar. 2017, 543:113-117.
Fang et al., "NK Cell-based Immunotherapy for Cancer," Seminars in Immunology, Aug. 2017, 31:37-54.
Grada et al., "TanCar: A Novel Bispecific Chimeric Antigen Receptor for Cancer Immunotherapy," Molecular Therapy- Nucleic Acids, Jul. 2013, vol. 2:e105, 11 pages.
Japanese Office Action mailed May 30, 2023 for Japanese Patent Application No. 2020-558861, a foreign counterpart to U.S. Pat. No. 10,561,686, 7 pages.
Lazar et al., "Transforming Growth Factor Alpha: Mutation of Aspartic Acid 47 and Leucine 48 Results in Different Biological Activities," Mol. Cell. Biol., Mar. 1988, 8(3):1247-1252.
Liu et al., "A Chimeric Switch-receptor Targeting PD1 Augments the Efficacy of Second-Generation CAR T Cells in Advanced Solid Tumors," Cancer Research, Mar. 2016, 76(6):1578-1590.
Magee et al., "GUCY2C-directed CAR-T Cells Oppose Colorectal Cancer Metastases Without Autoimmunity," OncoImmunology, Oct. 2016, 5(1):e1227897, 11 pages.
Mirzaei et al., "Chimeric Antigen Receptors T Cell Therapy in Solid Tumor: Challenges and Clinical Applications," Fronteirs in Immunology, Dec. 2017, 8:1850, 13 pages.
Roybal et al., "Engineering T cells with Customized Therapeutic Response Programs Using Synthetic Notch Receptors," Cell, Oct. 2016, 167:419-432.
Sarvaria et al., "B cell Regulation in Cancer and Anti-Tumor Immunity", Cellular and Molecular Immunology, Apr. 2017, 14:662-674.
Singapore Office Action mailed Feb. 28, 2023, in Singapore Application No. 11202107269X, a corresponding foreign application of U.S. Appl. No. 16/387,166, 12 pages.
Turtle et al., "Immunotherapy of non-Hodgkin's Lymphoma with a Defined Ratio of CD8+ and CD4+ CD19-specific Chimeric Antigen Receptor-modified T cells," Science Translational Medicine, Sep. 2016, 8:355: 29 pages.
Zhou et al., "The Use of tMUC1 Highly Specific Chimeric Antigen Receptor-redirected T cells for the Eradication of Triple Negative Breast Cancer," J Immunol, May 2017, 198 (1 Supplement):198.10, 2 pages, Abstract.
"Anti-ACPP Product Datasheet", Atlas Antibodies, retrieved on Oct. 31, 2019 from https://www.atlasantibodies.com/api/print_datasheet/HPA004335.pdf, Dec. 2012 1 page.
"Anti-UPK2 Product Datasheet", Atlas Antibodies, retrieved on Oct. 31, 2019 from https://www.atlasantibodies.com/api/print_datasheet/HPA061106.pdf, Dec. 2012, 1 page.
Chen, et al., "CAR T-cell intrinsic PD-1 checkpoint blockade: a two-in-one approach for solid tumor immunotherapy," Feb. 2017, OncoImmunology, 6:2, e1273302, DOI: 10.1080/2162402X.2016.1273302. 4 pages.
Extended European Search Report mailed Nov. 25, 2019 in EP Application No. 19180127.3, Xiao et al., a corresponding foreign application of U.S. Appl. No. 16/146,218, 11 pages.
Fang et al., "Stable antibody expression at therapeutic levels using the 2A peptide," May 2005, Nature Biotechnology. 23(5):584-590.
Invitation to Pay Additional Fees mailed on Nov. 13, 2019 for PCT Application PCT/US19/48890, 3 Pages.
PCT Communication Invitation to Pay Fees mailed Mar. 30, 2020 for PCT Application No. PCT/US20/13099, "Modified Cell Expansion and Uses Thereof", 2 pages.
Jernberg-Wiklund, et al., "Recombinant interferon-gamma inhibits the growth of IL-6-dependent human multiple myeloma cell lines in vitro," 1991. Eur J Haematol, 46:231.239.
Lee et al., "T cells expressing CD19 chimeric antigen receptors for acute lymphoblastic leukemia in children and young adults: a phase 1 dose-escalation trial," Oct. 2014. The Lancet, 385(9967): 517-528.
Maude et al., "Chimeric antigen receptor T cells for sustained remissions in leukemia," Oct. 2014. N Engl J Med. 371(16): 1507-1517.
Milone, et al., "Chimeric receptors containing CD137 signal transduction domains mediate enhanced survival of T cells and increased antileukemic efficacy in vivo," Apr. 2009. Molecular Therapy, 17(8): 1453-1464.
Partial European Search Report mailed Nov. 4, 2019 in EP Application No. 19180127.3, Xiao et al., a corresponding foreign application of U.S. Appl. No. 16/146,218, 18 pages.
International Preliminary Report on Patentability mailed Mar. 11, 2021 for PCT Application No. PCT/US19/48890, 8 pages.
International Search Report and Written Opinion mailed on Jun. 17, 2019 for PCT Application No. PCT/US19/13068, 14 pages.
International Search Report and Written Opinion mailed on Feb. 20, 2020 for PCT Application No. PCT/US19/62417, 14 pages.
International Search Report and Written Opinion mailed on Feb. 7, 2020 for PCT Application No. PCT/US19/48890, 15 pages.
International Search Report and Written Opinion mailed on Jun. 4, 2020 for PCT Application No. PCT/US2020/013099, 13 pages.
Qin et al., "Incorporation of a hinge domain improves the expansion of chimeric antigen receptor T cells," 2017, Journal of Hematology & Oncology, 10:68, 11 pages.
Sahm et al, "Expression of IL-15 in NK Cells Results in Rapid Enrichment and Selective Cytotoxicity of Gene-Modified Effectors That Carry a Tumor-Specific Antigen Receptor," Sep. 2012, Cancer Immunol Immunother, 61(9): 1451-1461.
Supplemental European Search Report mailed Jan. 13, 2020 in EP Application No. 19700326, Xiao et al., a corresponding foreign application of U.S. Appl. No. 16/146,218, 7 pages.
Takahashi, et al, "Expression of MUC1 on myeloma cells and induction of HJLA-unrestricted CTL against MUC1 from a multiple myeloma patient," 1994. J Immunol, 153:2102-2109.
Wilkie, et al. "Retargeting of human T cells to tumor-associated MUC1: The evolution of a chimeric antigen receptor," 2008, J. Immunol., 180:4901-4909.
Xiao et al., "Pre-clinical experiments of cart cells identifying tshr as a potential target against metastatic thyroid cancer," May 2018. Database EMBASE [Online] Elsevier Science Publishers, Database Accession No. EMB-623339571, 1 page.
You et al., "Phase 1 clinical trial demonstrated that MUC1 positive metastatic seminal vesicle cancer can be effectively eradicated y modified Anti-MUC1 chimeric antigen receptor transduced T cells", Apr. 2016, Science China: Life Sciences, 59(4): 386-397.
Rizzardi, et al., "Evaluation of Protein Biomarkers of Prostate Cancer Aggressiveness," Dec. 2014. BMC Cancer, 14(1): 14 pgs.
Examination Report for Australian Application No. 2019327490, Dated Feb. 16, 2026, 2 pages.

(56) References Cited

OTHER PUBLICATIONS

Hudecek, et al., "Receptor Affinity and Extracellular Domain Modifications Affect Tumor Recognition by ROR1-Specific Chimeric Antigen Receptor T-Cells," Clinical Cancer Research, vol. 19, No. 12, Jun. 2013, pp. 3153-3164.
Jensen, et al., "Designing Chimeric Antigen Receptors to Effectively and Safely Target Tumors," Current Opinion in Immunology, vol. 33, Apr. 2015, pp. 9-15.
Mihara, et al., "Synergistic and Persistent Effect of T-Cell Immonotherapy with Anti-CD19 or Anti-CD38 Chimeric Receptor in Conjunction with Rituximab on B-Cell Non-Hodgkin Lymphoma," British Journal of Haematology, vol. 151, Jul. 2010, pp. 37-46.
NCT02465983 Clinical Trial "Pilot Study of Autologous T-Cells in Patients with Metastatic Pancreatic Cancer" May 28, 2015, from https://clinicaltrials.gov/study/NCT02465983, 1 page.
Office Action for Australian Application No. 2019327490, Dated May 20, 2025, 5 pages.
Office Action for Canadian Application No. 3,110,096, Dated Jan. 27, 2025, 5 pages.
Office Action for Canadian Application No. 3,125,646, dated Dec. 19, 2025, 7 pages.
Gaut, et al., "Granulocyte Colony-Stimulating Factor (G-CSF) Interactions with Chimeric Antigen Receptor (CAR) T-Cell Therapy for Diffuse Large B-Cell Lymphoma," Blood, vol. 134, Supplemental_1, Nov. 2019, 4 pages.
Gene-NCBI, Search Results for "(pap) AND '*Homo sapiens*'[porgn:_txid9606]", downloaded Jan. 15, 2025 from https://www.ncbi.nlm.nih.gov/gene, 8 pages.
Office Action for Korean Application No. 10-2021-7025235, Dated Aug. 19, 2025, 26 pages.
Neumann, et al., "The Safety Profile of Filgrastim and Pegfilgrastim," Eds. G. Molineux et al., In: Twenty Years of G-CSF, Clinical and Nonclinical Discoveries, Basel: Springer Basel, 2011, pp. 395-408.
Prazma, et al., "Dendritic Cell CD83: A Therapeutic Target or Innocent Bystander?" Immunology Letters, vol. 115, 2008, pp. 1-8.
Office Action for Singapore Application No. 11202107269X, Dated Apr. 29, 2025, 9 pages.
Spunt, et al., "Phase II, Randomized, Open-Label Study of Pegfilgrastim-Supported VDC/IE Chemotherapy in Pediatric Sarcoma Patients," Journal of Clinical Oncology, vol. 28, No. 8, Mar. 2010, pp. 1329-1336.
Winkler, et al. "B-Lymphopoiesis is Stopped by Mobilizing Doses of G-CSF and is Rescued by Overexpression of the Anti-Apoptotic Protein Bcl2," Hematologica, vol. 98, No. 3, 2013, pp. 325-333.
Zhukovsky, et al., "Bispecific Antibodies and CARs: Generalized Immunotherapeutics Harnessing T Cell Redirection," Current Opinion in Immunology, vol. 40, Mar. 2016, pp. 24-35.

* cited by examiner

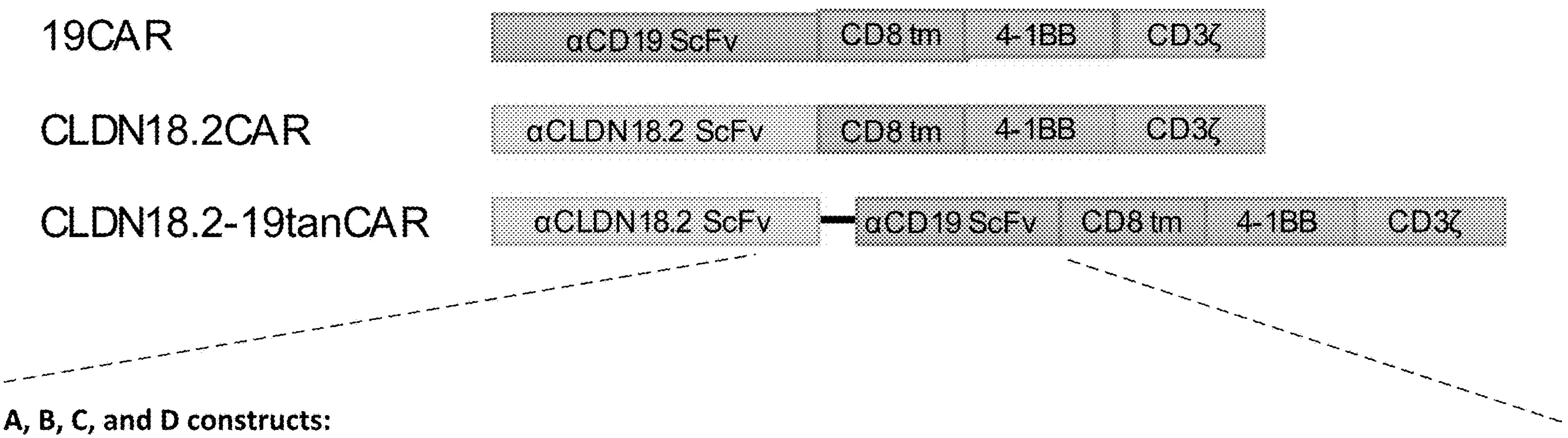

A, B, C, and D constructs:

**A: CD8sp-- Anti-18.2(175)-VL --3*GGGGS linker-- Anti-18.2(175)-VH --4*GGGGS tanCAR linker--humanized-anti CD19-VH--3*GGGGS linker-- Humanized-anti CD19-VL**

**B: CD8sp-- Anti-18.2（175）-VL --3*GGGGS linker-- Anti-18.2（175）-VH --4*GGGGS tanCAR linker-- humanized-anti CD19-VL--3*GGGGS linker-- humanized-anti CD19-VH**

**C: CD8sp-- humanized-anti CD19-VL--3*GGGGS linker-- humanized-anti CD19-VH --4*GGGGS tanCAR linker-- Anti-18.2（175）-VL --3*GGGGS linker-- Anti-18.2（175）-VH**

**D: CD8sp-- humanized-anti CD19-VL--3*GGGGS linker-- humanized-anti CD19-VH --4*GGGGS tanCAR linker-- Anti-18.2（175）-VH --3*GGGGS linker-- Anti-18.2（175）-VL**

175, 163, 125, and 43 refer to antibodies

FIG. 12

BiCAR T cell: CAR T cells expressing both tMUC1 CAR and CD19 CAR

Schematic overview of the process for combination of CAR T cells and tumor-infiltrating lymphocytes Objective lens multiple 10X
Day5

Patient 011

MODIFIED CELL EXPANSION AND USES THEREOF

CROSS REFERENCE TO RELATED PATENT APPLICATIONS

This application is a U.S. National Phase Application of International Application No. PCT/US2020/013099, filed Jan. 10, 2020, which is a continuation-in-part of U.S. application Ser. No. 16/445,965, filed Jun. 19, 2019; and U.S. application Ser. No. 16/387,166, filed Apr. 17, 2019. PCT/US2020/013099 also claims the benefit of U.S. Provisional Application 62/932,587, filed Nov. 8, 2019; U.S. Provisional Application 62/902,766, filed Sep. 19, 2019; U.S. Provisional Application 62/891,131, filed Aug. 23, 2019; U.S. Provisional Application 62/889,926, filed Aug. 21, 2019; U.S. Provisional Application 62/848,961, filed May 16, 2019; U.S. Provisional Application 62/846,563, filed May 10, 2019; U.S. Provisional Application 62/817,322, filed Mar. 12, 2019; U.S. Provisional Application 62/816,497, filed Mar. 11, 2019; U.S. Provisional Application 62/799,462, filed Jan. 31, 2019; and U.S. Provisional Application 62/790,783, filed Jan. 10, 2019. All of which are hereby incorporated by reference in their entirety.

SEQUENCE LISTING INFORMATION

A computer readable textfile, entitled "Sequence Listing_ST25.txt," created on or about Jul. 26, 2023 with a file size of about 1,252,096 bytes, contains the sequence listing for this application and is hereby incorporated by reference in its entirety.

TECHNICAL FIELD

The present disclosure relates to compositions and methods for expanding and maintaining modified cells including genetically modified cells, and uses thereof in the treatment of diseases, including cancer.

BACKGROUND

Chimeric Antigen Receptor (CAR) T cell therapy has achieved good clinical efficacy in cancer such as B-cell acute lymphoblastic leukemia (B-ALL), chronic lymphocytic leukemia (CLL), and lymphoma. However, progress is relatively slow for treatment of solid tumors. For CAR T cell therapy to be effective, long-term maintenance of CAR T cells in a patient is important for the prognosis of the patient in the treatment of tumors. For example, if the long-term presence of CAR T cells can be maintained, this technology may effectively reduce tumor recurrence.

Cancer is known as malignant tumors involving abnormal cell growth with the potential to invade or spread to other parts of the body. In humans, there are more than one hundred types of cancer. One example is breast cancer occurring in the epithelial tissue of the breast. Since breast cancer cells lose the characteristics of normal cells, the connection between breast cancer cells is lost. Once cancer cells are exfoliated, they spread over the entire body via the blood and/or lymph systems and therefore become life-threatening. Currently, breast cancer has become one of the common threats to women's physical and mental health. Although immunotherapy (e.g., CAR T) has been proven to be effective for treating some cancers, there is still a need to improve immunotherapy so that it is effective in treating more cancers including those involving solid tumors.

SUMMARY

Since a patient can survive the depletion of B cells, B cells of the patient may be used to expand the CAR T cells in the patient using a first antigen binding domain of the CAR T cell. Accordingly, more CAR T cells may be timely expanded in the patient, increasing the potency of CAR T cells. The timely expanded CAR T cells in the patient may increase the chances for the CAR T cells to come in contact with tumor cells, especially solid tumor cells having the antigen that a second CAR binds.

The present disclosure describes genetically modified cells that include one or more different antigen binding domains. The genetically modified cells can include at least two different antigen binding domains: a first antigen binding domain for expanding and/or maintaining the genetically modified cells, and a second antigen binding domain for killing a target cell, such as a tumor cell. For example, the first antigen binding domain binds a surface marker, such as a cell surface molecule of a white blood cell (WBC), and the second antigen binding domain binds a target antigen of tumor cells. In embodiments, the cell surface molecule is a surface antigen of a WBC. A CAR can comprise the first or second antigen binding domain. The modified cells comprise the first and second antigen binding domains. In embodiments, the modified cells comprise modified cells comprising (1) a first group of modified cells comprising the first antigen binding domain and (2) a second group of modified cells comprising the second binding domain. In embodiments, the modified cells are a mixed population comprising two different groups of modified cells The CAR can be a bispecific CAR. For example, the two antigen binding domains are on the same CAR (a bispecific CAR or tandem CAR (tanCAR)), on different CAR molecules, or on a CAR and T cell receptor (TCR). A single CAR can include at least two different antigen binding domains, or the two different antigen binding domains are each on a separate CAR.

The present disclosure also describes one or more nucleic acids encoding a first CAR molecule and a second CAR molecule or a TCR. The first CAR includes the first antigen binding domain and the second CAR or TCR includes the second antigen binding domain. In embodiments, the first CAR and the second CAR or TCR are expressed as separate polypeptides and encoded by at least two separate nucleic acids. In embodiments, a single CAR contains at least the first and second antigen binding domains described herein and is encoded by a single nucleic acid. In embodiments, the two different antigen binding domains can be encoded by more than one nucleic acids. Moreover, the present disclosure describes vectors containing the nucleic acids described herein and cells comprising the nucleic acids described herein. In embodiments, the cells include genetically modified cells, for example genetically modified T cells, such as CAR T cells.

The present disclosure also describes a population of modified cells, such as a mixed population of modified T cells, effective for expanding and/or maintaining the genetically modified cells in a patient. In embodiments, the mixed population of genetically modified cells includes at least two different genetically modified cells, a first genetically modified cell expressing an antigen binding domain for expanding and/or maintaining the modified cells and a second genetically modified cell expressing an antigen binding domain for killing a target cell, such as a tumor cell. The two antigen binding domains are different molecules and bind different antigens. In embodiments, the mixed population of genetically modified cells further includes a third genetically modified cell expressing at least two different antigen binding domains, a first antigen binding domain for expanding and/or maintaining the genetically modified cell and a second antigen binding domain for killing a target cell (wherein the two different antigen binding domains are expressed on the same cell).

In embodiments, the mixed population of modified cells includes genetically modified cells expressing at least two different antigen binding domains, a first antigen binding domain for expanding and/or maintaining the modified cells and a second antigen binding domain for killing a target cell (wherein the two different antigen binding domains are expressed on the same cell).

In embodiments, the mixed population of modified cells includes a modified cell expressing an antigen binding domain for killing a target cell and a modified cell expressing at least two antigen binding domains, a first antigen binding domain for expanding and/or maintaining the modified T cells and a second antigen binding domain for killing a target cell (wherein the two different antigen binding domains are expressed on the same modified cell).

In embodiments, the mixed population of modified cells includes a modified cell expressing an antigen binding domain for expanding and/or maintaining the modified T cells and a modified cell expressing at least two antigen binding domains, a first antigen binding domain for expanding and/or maintaining the modified cell and a second antigen binding domain for killing a target cell (wherein the two different antigen binding domains are expressed on the same modified cell).

The present disclosure describes compositions comprising the mixed population of modified cells described herein.

In embodiments, the modified cell is a modified T cell, a modified NK cell, a modified macrophage, or a modified dendritic cell. In embodiments, the modified T cell is a CAR T cell. In embodiments, the modified cell expressing two different antigen binding domains can be a single CAR T cell. In embodiments, the single CAR T cell can be a bispecific CAR T cell.

In embodiments, the antigen binding domain for expanding and/or maintaining the modified cell binds the surface antigen of a WBC, and the antigen binding domain for killing a target cell binds a tumor antigen. In embodiments, the WBC is a B cell. In embodiments, the surface antigen of a B cell is CD19, and the tumor antigen is tMUC1, TSHR, GUCY2C, ACPP, CLDN18.2 (18.2), PSMA, UPK2, or other tumor antigens.

Furthermore, the present disclosure describes the use of the composition or the mixed population of modified cells described herein for enhancing expansion and/or maintenance of CAR T cells in patients in need thereof. The enhanced expansion and maintenance of CAR T cells improves the efficacy of the CAR T cell therapy. The present disclosure describes a method of treating a patient having tumor with a mixed population of modified cells described herein. In embodiments, the mixed population of genetically modified cells expands and/or maintains the modified cells in the patient and effectively inhibits the growth of the tumor. In embodiments, the tumor is a solid tumor.

Additionally, the present disclosure describes the release of cytokines in response to the introduction of the mixed population of modified cells.

This Summary is not intended to identify key features or essential features of the claimed subject matter, nor is it intended to be used to limit the scope of the claimed subject matter.

BRIEF DESCRIPTION OF THE DRAWINGS

The Detailed Description is described with reference to the accompanying figures. The use of the same reference numbers in different figures indicates similar or identical items.

FIG. 12 shows schematic diagrams of nucleic acid constructs of CAR molecules.

DETAILED DESCRIPTION

Figure 1:
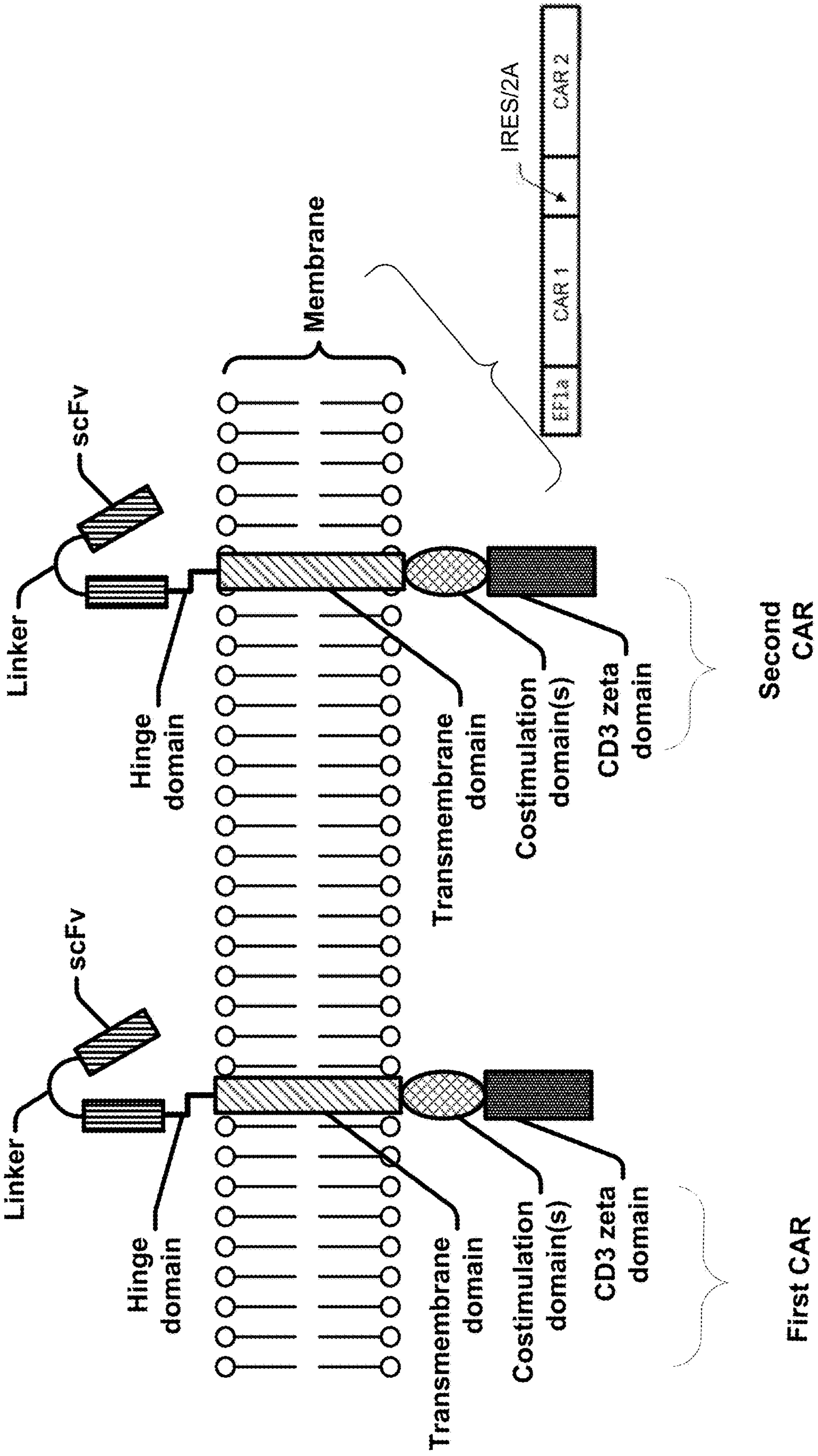
FIG. 1 is a schematic diagram of an exemplary portion of a cell membrane of a modified cell including two CAR molecules.
Figure 2:
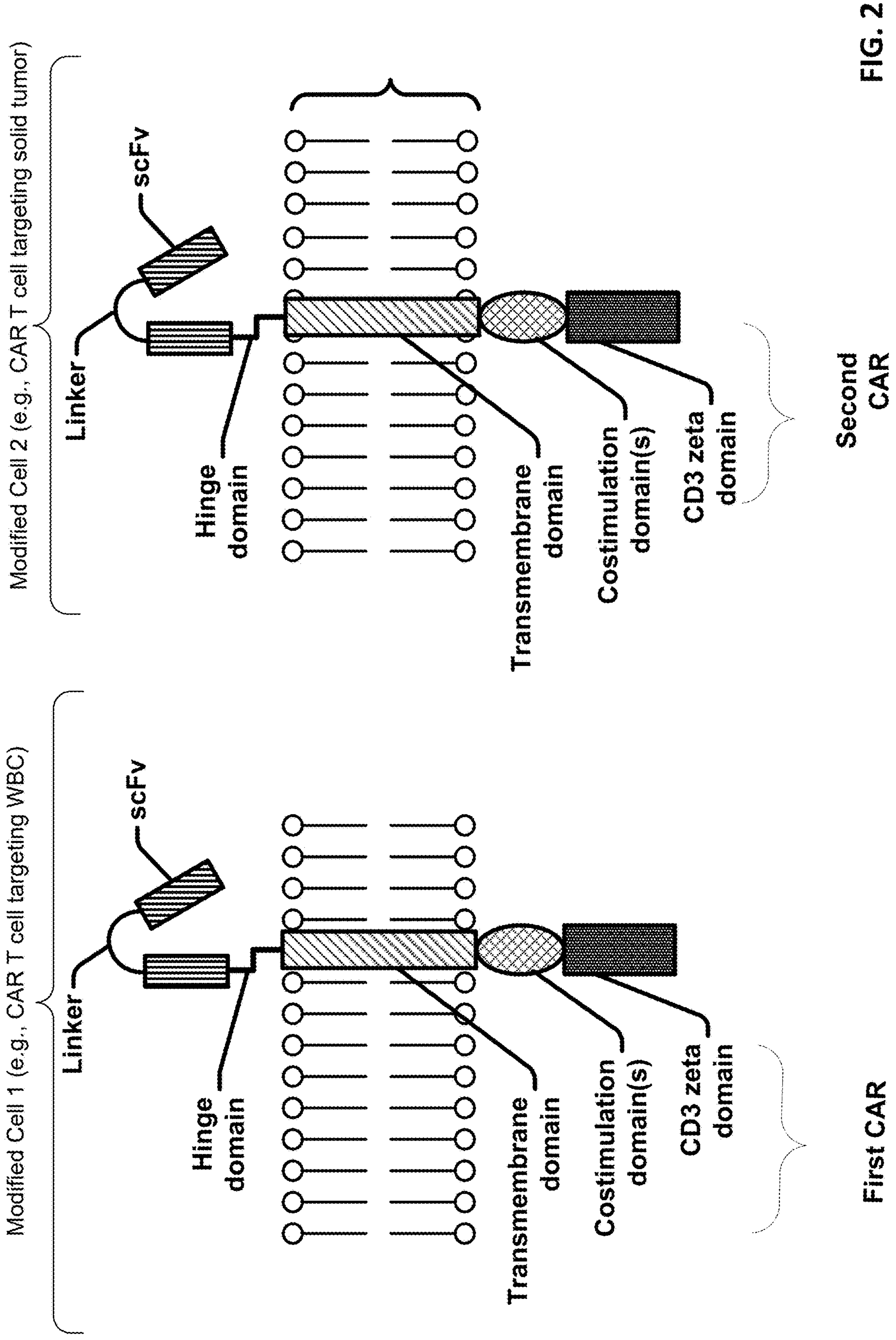
FIG. 2 is a schematic diagram showing a mixed population of modified cells including two modified cells having different CAR molecules.
Figure 3:
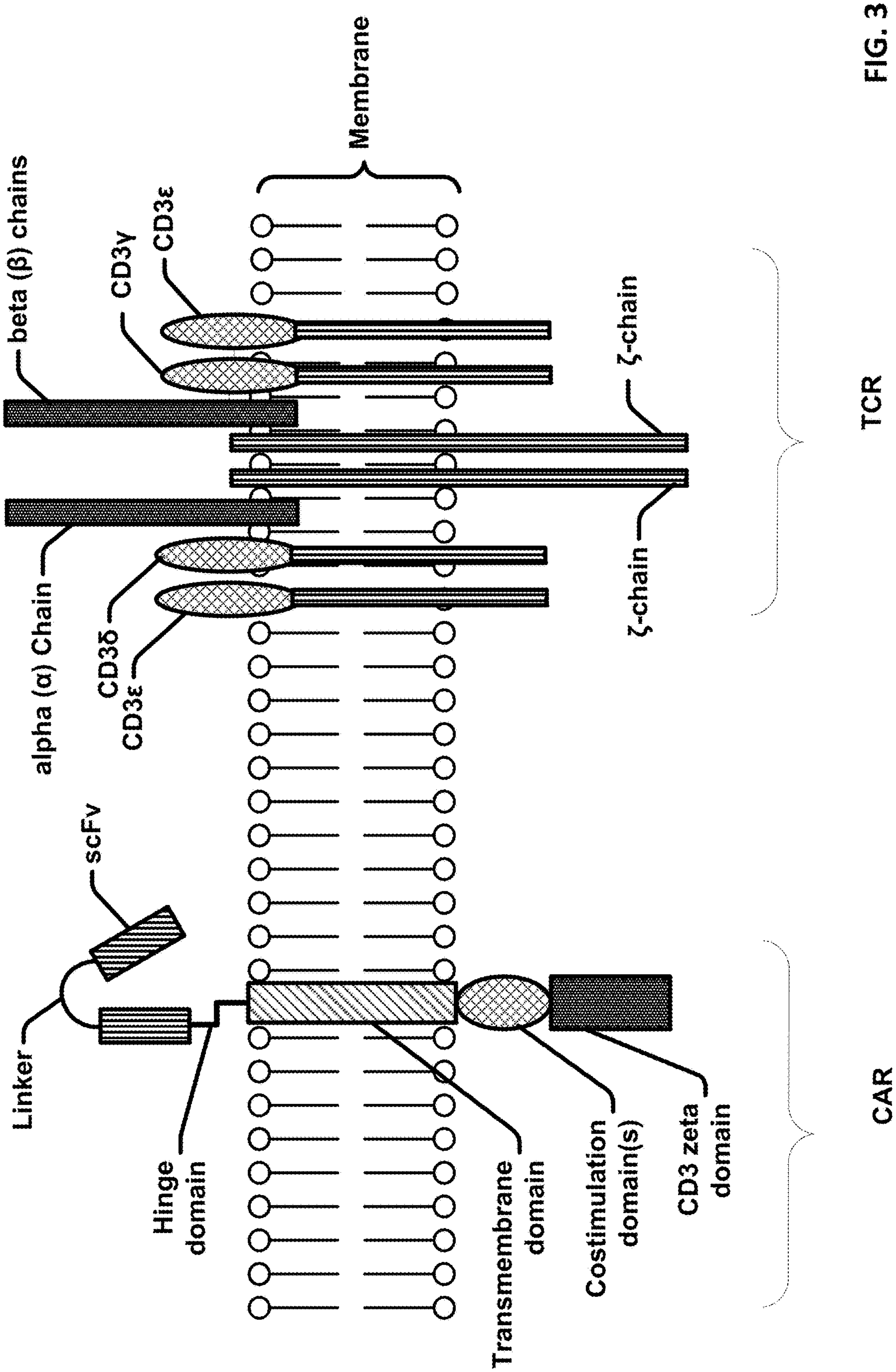
FIG. 3 is a schematic diagram showing an exemplary portion of a cell membrane comprising a CAR and a TCR molecules.
Figure 4:
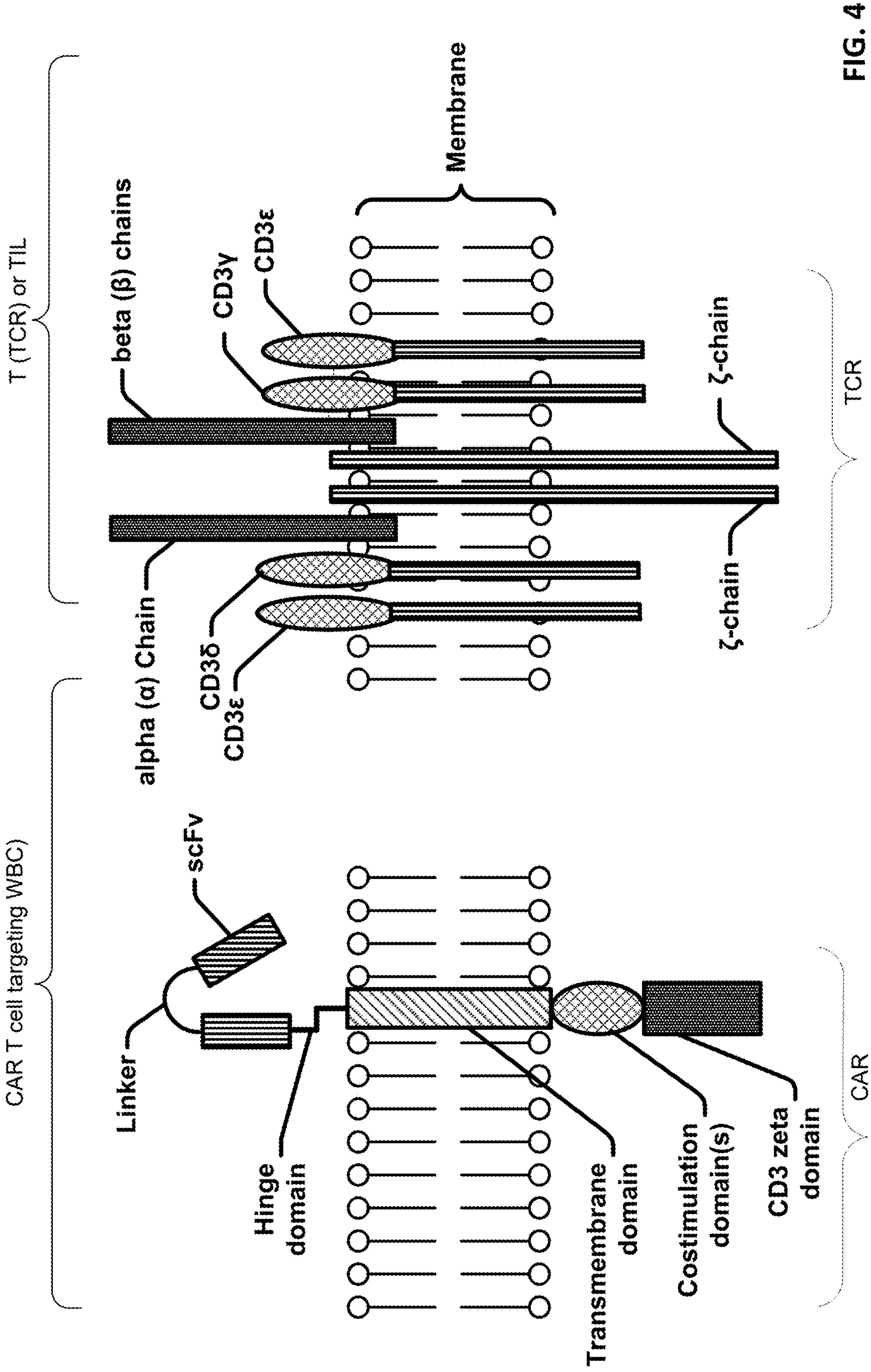
FIG. 4 is a schematic diagram showing a mixed population of modified cells including a modified cell comprising a CAR molecule and a modified cell comprising a T cell receptor (TCR).

Unless defined otherwise, all technical and scientific terms used herein have the same meaning as commonly understood by those of ordinary skill in the art to which the disclosure belongs. Although any method and material similar or equivalent to those described herein can be used in the practice or testing of the present disclosure, preferred methods and materials are described. For the purposes of the present disclosure, the following terms are defined below.

The articles "a" and "an" are used herein to refer to one or to more than one (i.e., to at least one) of the grammatical object of the article. By way of example, "an element" means one element or more than one element.

By "about" is meant a quantity, level, value, number, frequency, percentage, dimension, size, amount, weight or length that varies by as much as 20, 15, 10, 9, 8, 7, 6, 5, 4, 3, 2 or 1% to a reference quantity, level, value, number, frequency, percentage, dimension, size, amount, weight or length.

The term "activation," as used herein, refers to the state of a cell that has been sufficiently stimulated to induce detectable cellular proliferation. Activation can also be associated with induced cytokine production and detectable effector functions. The term "activated T cells" refers to, among other things, T cells that are undergoing cell division.

The term "antibody" is used in the broadest sense and refers to monoclonal antibodies (including full length monoclonal antibodies), polyclonal antibodies, multi-specific antibodies (e.g., bispecific antibodies), and antibody fragments so long as they exhibit the desired biological activity or function. The antibodies in the present disclosure may exist in a variety of forms including, for example, polyclonal antibodies; monoclonal antibodies; Fv, Fab, Fab', and F(ab') 2 fragments; as well as single chain antibodies and humanized antibodies (Harlow et al., 1999, In: Using Antibodies: A Laboratory Manual, Cold Spring Harbor Laboratory Press, NY; Harlow et al., 1989, In: Antibodies: A Laboratory Manual, Cold Spring Harbor, New York; Houston et al., 1988, Proc. Natl. Acad. Sci. USA 85:5879-5883; Bird et al., 1988, Science 242:423-426).

The term "antibody fragments" refers to a portion of a full-length antibody, for example, the antigen binding or variable region of the antibody. Other examples of antibody fragments include Fab, Fab', $F(ab')_2$, and Fv fragments; diabodies; linear antibodies; single-chain antibody molecules; and multi-specific antibodies formed from antibody fragments.

The term "Fv" refers to the minimum antibody fragment which contains a complete antigen-recognition and -binding site. This fragment consists of a dimer of one heavy- and one light-chain variable region domain in tight, non-covalent association. From the folding of these two domains emanates six hypervariable loops (3 loops each from the H and L chain) that contribute amino acid residues for antigen binding and confer antigen binding specificity to the antibody. However, even a single variable domain (or half of an Fv including only three complementarity determining regions (CDRs) specific for an antigen) has the ability to recognize and bind antigen, although at a lower affinity than the entire binding site (the dimer).

An "antibody heavy chain," as used herein, refers to the larger of the two types of polypeptide chains present in all antibody molecules in their naturally occurring conformations. An "antibody light chain," as used herein, refers to the smaller of the two types of polypeptide chains present in all antibody molecules in their naturally occurring conformations. K and A light chains refer to the two major antibody light chain isotypes.

The term "synthetic antibody" refers to an antibody which is generated using recombinant DNA technology, such as, for example, an antibody expressed by a bacteriophage. The term also includes an antibody which has been generated by the synthesis of a DNA molecule encoding the antibody and the expression of the DNA molecule to obtain the antibody or to obtain an amino acid encoding the antibody. The synthetic DNA is obtained using technology that is available and well known in the art.

The term "antigen" refers to a molecule that provokes an immune response, which may involve either antibody production, or the activation of specific immunologically-competent cells, or both. Antigens include any macromolecule, including all proteins or peptides, or molecules derived from recombinant or genomic DNA. For example, DNA including a nucleotide sequence or a partial nucleotide sequence encoding a protein or peptide that elicits an immune response, and therefore, encodes an "antigen" as the term is used herein. An antigen need not be encoded solely by a full-length nucleotide sequence of a gene. An antigen can be generated, synthesized or derived from a biological sample including a tissue sample, a tumor sample, a cell, or a biological fluid.

The term "anti-tumor effect" as used herein, refers to a biological effect associated with a decrease in tumor volume, a decrease in the number of tumor cells, a decrease in the number of metastases, decrease in tumor cell proliferation, decrease in tumor cell survival, an increase in life expectancy of a subject having tumor cells, or amelioration of various physiological symptoms associated with the cancerous condition. An "anti-tumor effect" can also be manifested by the ability of the peptides, polynucleotides, cells, and antibodies in the prevention of the occurrence of tumor in the first place.

The term "auto-antigen" refers to an endogenous antigen mistakenly recognized by the immune system as being foreign. Auto-antigens include cellular proteins, phosphoproteins, cellular surface proteins, cellular lipids, nucleic acids, glycoproteins, including cell surface receptors.

The term "autologous" is used to describe a material derived from a subject which is subsequently re-introduced into the same subject.

The term "allogeneic" is used to describe a graft derived from a different subject of the same species. As an example, a donor subject may be a related or unrelated to the recipient subject, but the donor subject has immune system markers which are similar to the recipient subject.

The term "xenogeneic" is used to describe a graft derived from a subject of a different species. As an example, the donor subject is from a different species than a recipient subject, and the donor subject and the recipient subject can be genetically and immunologically incompatible.

The term "cancer" is used to refer to a disease characterized by the rapid and uncontrolled growth of aberrant cells. Cancer cells can spread locally or through the bloodstream and lymphatic system to other parts of the body. Examples of various cancers include breast cancer, prostate cancer, ovarian cancer, cervical cancer, skin cancer, pancreatic cancer, colorectal cancer, renal cancer, liver cancer, brain cancer, lymphoma, leukemia, lung cancer, and the like.

Throughout this specification, unless the context requires otherwise, the words "comprise," "includes" and "including" will be understood to imply the inclusion of a stated step or element or group of steps or elements but not the exclusion of any other step or element or group of steps or elements.

The phrase "consisting of" is meant to include, and is limited to, whatever follows the phrase "consisting of." Thus, the phrase "consisting of" indicates that the listed elements are required or mandatory and that no other elements may be present.

The phrase "consisting essentially of" is meant to include any element listed after the phrase and can include other elements that do not interfere with or contribute to the activity or action specified in the disclosure for the listed elements. Thus, the phrase "consisting essentially of" indicates that the listed elements are required or mandatory, but that other elements are optional and may or may not be present depending upon whether or not they affect the activity or action of the listed elements.

The terms "complementary" and "complementarity" refer to polynucleotides (i.e., a sequence of nucleotides) related by the base-pairing rules. For example, the sequence "A-G-T," is complementary to the sequence "T-C-A." Complementarity may be "partial," in which only some of the nucleic acids' bases are matched according to the base pairing rules, or there may be "complete" or "total" complementarity between the nucleic acids. The degree of complementarity between nucleic acid strands has significant effects on the efficiency and strength of hybridization between nucleic acid strands.

The term "corresponds to" or "corresponding to" refers to (a) a polynucleotide having a nucleotide sequence that is substantially identical or complementary to all or a portion of a reference polynucleotide sequence or encoding an amino acid sequence identical to an amino acid sequence in a peptide or protein; or (b) a peptide or polypeptide having an amino acid sequence that is substantially identical to a sequence of amino acids in a reference peptide or protein.

The term "co-stimulatory ligand," refers to a molecule on an antigen presenting cell (e.g., an APC, dendritic cell, B cell, and the like) that specifically binds a cognate co-stimulatory molecule on a T cell, thereby providing a signal which, in addition to the primary signal provided by, for instance, binding of a TCR/CD3 complex with an MHC molecule loaded with peptide, mediates a T cell response, including at least one of proliferation, activation, differentiation, and other cellular responses. A co-stimulatory ligand can include B7-1 (CD80), B7-2 (CD86), PD-L1, PD-L2, 4-1BBL, OX40L, inducible co-stimulatory ligand (ICOS-L), intercellular adhesion molecule (ICAM), CD30L, CD40, CD70, CD83, HLA-G, MICA, MICB, HVEM, lymphotoxin beta receptor, 3/TR6, ILT3, ILT4, HVEM, a ligand for CD7, an agonist or antibody that binds the Toll ligand receptor, and a ligand that specifically binds with B7-H3. A co-stimulatory ligand also includes, inter alia, an agonist or an antibody that specifically binds with a co-stimulatory molecule present on a T cell, such as CD27, CD28, 4-1BB, OX40, CD30, CD40, PD-1, ICOS, lymphocyte function-associated antigen-1 (LFA-1), CD2, CD7, LIGHT, NKG2C, B7-H3, and a ligand that specifically binds CD83.

The term "co-stimulatory molecule" refers to the cognate binding partner on a T cell that specifically binds with a co-stimulatory ligand, thereby mediating a co-stimulatory response by the T cell, such as proliferation. Co-stimulatory molecules include an MHC class I molecule, BTLA, and a Toll-like receptor.

The term "co-stimulatory signal" refers to a signal, which in combination with a primary signal, such as TCR/CD3 ligation, leads to T cell proliferation and/or upregulation or downregulation of key molecules.

The terms "disease" and "condition" may be used interchangeably or may be different in that the particular malady or condition may not have a known causative agent (so that etiology has not yet been worked out), and it is therefore not yet recognized as a disease but only as an undesirable condition or syndrome, wherein a more or less specific set of symptoms have been identified by clinicians. The term "disease" is a state of health of a subject wherein the subject cannot maintain homeostasis, and wherein if the disease is not ameliorated then the subject's health continues to deteriorate. In contrast, a "disorder" in a subject is a state of health in which the animal is able to maintain homeostasis, but in which the animal's state of health is less favorable than it would be in the absence of the disorder. Left untreated, a disorder does not necessarily cause a further decrease in the animal's state of health.

The term "effective" refers to adequate to accomplish a desired, expected, or intended result. For example, an "effective amount" in the context of treatment may be an amount of a compound sufficient to produce a therapeutic or prophylactic benefit.

The term "encoding" refers to the inherent property of specific sequences of nucleotides in a polynucleotide, such as a gene, a cDNA, or an mRNA, to serve as a template for synthesis of other polymers and macromolecules in biological processes having either a defined sequence of nucleotides (i.e., rRNA, tRNA and mRNA) or a defined sequence of amino acids and the biological properties resulting therefrom. Thus, a gene encodes a protein if transcription and translation of mRNA corresponding to that gene produces the protein in a cell or other biological system. Both the coding strand, the nucleotide sequence of which is identical to the mRNA sequence (except that a "T" is replaced by a "U") and is usually provided in sequence listings, and the non-coding strand, used as the template for transcription of a gene or cDNA, can be referred to as encoding the protein or other product of that gene or cDNA.

The term "exogenous" refers to a molecule that does not naturally occur in a wild-type cell or organism but is typically introduced into the cell by molecular biological techniques. Examples of exogenous polynucleotides include vectors, plasmids, and/or man-made nucleic acid constructs encoding the desired protein. With regard to polynucleotides and proteins, the term "endogenous" or "native" refers to naturally-occurring polynucleotide or amino acid sequences that may be found in a given wild-type cell or organism. Also, a particular polynucleotide sequence that is isolated from a first organism and transferred to a second organism by molecular biological techniques is typically considered an "exogenous" polynucleotide or amino acid sequence with respect to the second organism. In specific embodiments, polynucleotide sequences can be "introduced" by molecular biological techniques into a microorganism that already contains such a polynucleotide sequence, for instance, to create one or more additional copies of an otherwise naturally-occurring polynucleotide sequence, and thereby facilitate overexpression of the encoded polypeptide.

The term "expression or overexpression" refers to the transcription and/or translation of a particular nucleotide sequence into a precursor or mature protein, for example, driven by its promoter. "Overexpression" refers to the production of a gene product in transgenic organisms or cells that exceeds levels of production in normal or non-transformed organisms or cells. As defined herein, the term "expression" refers to expression or overexpression.

The term "expression vector" refers to a vector including a recombinant polynucleotide including expression control (regulatory) sequences operably linked to a nucleotide sequence to be expressed. An expression vector includes sufficient cis-acting elements for expression; other elements for expression can be supplied by the host cell or in an in vitro expression system. Expression vectors include all those known in the art, such as cosmids, plasmids (e.g., naked or contained in liposomes) and viruses (e.g., lentiviruses, retroviruses, adenoviruses, and adeno-associated viruses) that incorporate the recombinant polynucleotide.

Viruses can be used to deliver nucleic acids into a cell in vitro and in vivo (in a subject). Examples of viruses useful for delivery of nucleic acids into cells include retrovirus, adenovirus, herpes simplex virus, vaccinia virus, and adeno-associated virus.

There also exist non-viral methods for delivering nucleic acids into a cell, for example, electroporation, gene gun, sonoporation, magnetofection, and the use of oligonucleotides, lipoplexes, dendrimers, and inorganic nanoparticles.

The term "homologous" refers to sequence similarity or sequence identity between two polypeptides or between two polynucleotides when a position in both of the two compared sequences is occupied by the same base or amino acid monomer subunit, e.g., if a position in each of two DNA molecules is occupied by adenine, then the molecules are homologous at that position. The percent of homology between two sequences is a function of the number of matching or homologous positions shared by the two sequences divided by the number of positions compared ×100. For example, if 6 of 10 of the positions in two sequences are matched or homologous, then the two sequences are 60% homologous. By way of example, the DNA sequences ATTGCC and TATGGC share 50% homology. A comparison is made when two sequences are aligned to give maximum homology.

The term "immunoglobulin" or "lg," refers to a class of proteins, which function as antibodies. The five members included in this class of proteins are IgA, IgG, IgM, IgD, and IgE. IgA is the primary antibody that is present in body secretions, such as saliva, tears, breast milk, gastrointestinal secretions and mucus secretions of the respiratory and genitourinary tracts. IgG is the most common circulating antibody. IgM is the main immunoglobulin produced in the primary immune response in most subjects. It is the most efficient immunoglobulin in agglutination, complement fixation, and other antibody responses, and is important in defense against bacteria and viruses. IgD is the immunoglobulin that has no known antibody function but may serve as an antigen receptor. IgE is the immunoglobulin that mediates immediate hypersensitivity by causing the release of mediators from mast cells and basophils upon exposure to the allergen.

The term "isolated" refers to a material that is substantially or essentially free from components that normally accompany it in its native state. The material can be a cell or a macromolecule such as a protein or nucleic acid. For example, an "isolated polynucleotide," as used herein, refers to a polynucleotide, which has been purified from the sequences which flank it in a naturally-occurring state, e.g., a DNA fragment which has been removed from the sequences that are normally adjacent to the fragment. Alternatively, an "isolated peptide" or an "isolated polypeptide" and the like, as used herein, refer to in vitro isolation and/or purification of a peptide or polypeptide molecule from its natural cellular environment, and from association with other components of the cell.

The term "substantially purified" refers to a material that is substantially free from components that are normally associated with it in its native state. For example, a substantially purified cell refers to a cell that has been separated from other cell types with which it is normally associated in its naturally occurring or native state. In some instances, a population of substantially purified cells refers to a homogenous population of cells. In other instances, this term refers simply to a cell that has been separated from the cells with which they are naturally associated in their natural state. In embodiments, the cells are cultured in vitro. In embodiments, the cells are not cultured in vitro.

In the context of the present disclosure, the following abbreviations for the commonly occurring nucleic acid bases are used. "A" refers to adenosine, "C" refers to cytosine, "G" refers to guanosine, "T" refers to thymidine, and "U" refers to uridine.

Unless otherwise specified, a "nucleotide sequence encoding an amino acid sequence" includes all nucleotide sequences that are degenerate versions of each other and that encode the same amino acid sequence. The phrase nucleotide sequence that encodes a protein or an RNA may also include introns to the extent that the nucleotide sequence encoding the protein may in some version contain an intron(s).

The term "lentivirus" refers to a genus of the Retroviridae family. Lentiviruses are unique among the retroviruses in being able to infect non-dividing cells; they can deliver a significant amount of genetic information into the DNA of the host cell, so they are one of the most efficient methods of a gene delivery vector. Moreover, the use of lentiviruses enables integration of the genetic information into the host chromosome resulting in stably transduced genetic information. HIV, SIV, and FIV are all examples of lentiviruses. Vectors derived from lentiviruses offer the means to achieve significant levels of gene transfer in vivo.

The term "modulating," refers to mediating a detectable increase or decrease in the level of a response in a subject compared with the level of a response in the subject in the absence of a treatment or compound, and/or compared with the level of a response in an otherwise identical but untreated subject. The term encompasses perturbing and/or affecting a native signal or response thereby mediating a beneficial therapeutic response in a subject, preferably, a human.

Nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation.

The term "under transcriptional control" refers to a promoter being operably linked to and in the correct location and orientation in relation to a polynucleotide to control (regulate) the initiation of transcription by RNA polymerase and expression of the polynucleotide.

The term "overexpressed" tumor antigen or "overexpression" of the tumor antigen is intended to indicate an abnormal level of expression of the tumor antigen in a cell from a disease area such as a solid tumor within a specific tissue or organ of the patient relative to the level of expression in a normal cell from that tissue or organ. Patients having solid tumor or a hematological malignancy characterized by overexpression of the tumor antigen can be determined by standard assays known in the art.

Solid tumors are abnormal masses of tissue that usually do not contain cysts or liquid areas. Solid tumors can be benign or malignant. Different types of solid tumors are named for the type of cells that form them (such as sarcomas, carcinomas, and lymphomas). Examples of solid tumors, such as sarcomas and carcinomas, include fibrosarcoma, myxosarcoma, liposarcoma, chondrosarcoma, osteosarcoma, synovioma, mesothelioma, Ewing's tumor, leiomyosarcoma, rhabdomyosarcoma, colon carcinoma, lymphoid malignancy, pancreatic cancer, breast cancer, lung cancers, ovarian cancer, prostate cancer, hepatocellular carcinoma, squamous cell carcinoma, basal cell carcinoma, adenocarcinoma, sweat gland carcinoma, medullary thyroid carcinoma, papillary thyroid carcinoma, pheochromocytomas sebaceous gland carcinoma, papillary carcinoma, papillary adenocarcinomas, medullary carcinoma, bronchogenic carcinoma, renal cell carcinoma, hepatoma, bile duct carcinoma, choriocarcinoma, Wilms' tumor, cervical cancer, testicular tumor, seminoma, bladder carcinoma, melanoma, and CNS tumors (such as a glioma (such as brainstem glioma and mixed gliomas), glioblastoma (also known as glioblastoma multiforme), astrocytoma, CNS lymphoma, germinoma, medulloblastoma, Schwannoma craniopharyogioma, ependymoma, pinealoma, hemangioblastoma, acoustic neuroma, oligodendroglioma, menangioma, neuroblastoma, retinoblastoma, and brain metastases).

A solid tumor antigen is an antigen expressed on a solid tumor. In embodiments, solid tumor antigens are also expressed at low levels on healthy tissue. Examples of solid tumor antigens and their related disease tumors are provided in Table 1.

TABLE 1

| Solid Tumor antigen | Disease tumor |
|---|---|
| PRLR | Breast Cancer |
| CLCA1 | colorectal Cancer |
| MUC12 | colorectal Cancer |
| GUCY2C | colorectal Cancer |
| GPR35 | colorectal Cancer |
| CR1L | Gastric Cancer |
| MUC 17 | Gastric Cancer |
| TMPRSS11B | esophageal Cancer |
| MUC21 | esophageal Cancer |
| TMPRSS11E | esophageal Cancer |
| CD207 | bladder Cancer |
| SLC30A8 | pancreatic Cancer |
| CFC1 | pancreatic Cancer |
| SLC12A3 | Cervical Cancer |
| SSTR1 | Cervical tumor |
| GPR27 | Ovary tumor |
| FZD10 | Ovary tumor |
| TSHR | Thyroid Tumor |
| SIGLEC15 | Urothelial cancer |
| SLC6A3 | Renal cancer |
| KISS1R | Renal cancer |
| QRFPR | Renal cancer: |
| GPR119 | Pancreatic cancer |
| CLDN6 | Endometrial cancer/Urothelial cancer |
| UPK2 | Urothelial cancer (including bladder cancer) |
| ADAM12 | Breast cancer, pancreatic cancer and the like |
| SLC45A3 | Prostate cancer |
| ACPP | Prostate cancer |
| MUC21 | Esophageal cancer |
| MUC16 | Ovarian cancer |
| MS4A12 | Colorectal cancer |
| ALPP | Endometrial cancer |
| CEA | Colorectal carcinoma |
| EphA2 | Glioma |
| FAP | Mesotelioma |
| GPC3 | Lung squamous cell carcinoma |
| IL13-Rα2 | Glioma |
| Mesothelin | Metastatic cancer |
| PSMA | Prostate cancer |
| ROR1 | Breast lung carcinoma |
| VEGFR-II | Metastatic cancer |
| GD2 | Neuroblastoma |
| FR-α | Ovarian carcinoma |
| ErbB2 | Carcinomasb |
| EpCAM | Carcinomasa |
| EGFRvIII | Glioma—Glioblastoma |
| EGFR | Glioma—NSCL cancer |
| tMUC1 | Cholangiocarcinoma, Pancreatic cancer, Breast |
| PSCA | pancreas, stomach, or prostate cancer |
| FCER2, GPR18, FCRLA, CXCR5, FCRL3, FCRL2, HTR3A, and CLEC17A | breast cancer |
| TRPMI, SLC45A2, and SLC24A5 | lymphoma |
| DPEP3 | melanoma |
| KCNK16 | ovarian, testis |
| LIM2 or KCNV2 | pancreatic |
| SLC26A4 | thyroid cancer |
| CD171 | Neuroblastoma |
| Glypican-3 | Sarcoma |
| IL-13 | Glioma |
| CD79a/b | Lymphoma |

The term "parenteral administration" of a composition includes, e.g., subcutaneous (s.c.), intravenous (i.v.), intramuscular (i.m.), intrasternal injection, or infusion techniques.

The terms "patient," "subject," and "individual," and the like apre used interchangeably herein and refer to any human, or animal, amenable to the methods described herein. In certain non-limiting embodiments, the patient, subject, or individual is a human or animal. In embodiments, the term "subject" is intended to include living organisms in which an immune response can be elicited (e.g., mammals). Examples of subjects include humans, and animals, such as dogs, cats, mice, rats, and transgenic species thereof.

A subject in need of treatment or in need thereof includes a subject having a disease, condition, or disorder that needs to be treated. A subject in need thereof also includes a subject that needs treatment for prevention of a disease, condition, or disorder.

The term "polynucleotide" or "nucleic acid" refers to mRNA, RNA, CRNA, rRNA, cDNA or DNA. The term typically refers to a polymeric form of nucleotides of at least 10 bases in length, either ribonucleotides or deoxynucleotides or a modified form of either type of nucleotide. The term includes all forms of nucleic acids including single and double-stranded forms of nucleic acids.

The terms "polynucleotide variant" and "variant" and the like refer to polynucleotides displaying substantial sequence identity with a reference polynucleotide sequence or polynucleotides that hybridize with a reference sequence under stringent conditions that are defined hereinafter. These terms also encompass polynucleotides that are distinguished from a reference polynucleotide by the addition, deletion or substitution of at least one nucleotide. Accordingly, the terms "polynucleotide variant" and "variant" include polynucleotides in which one or more nucleotides have been added or deleted or replaced with different nucleotides. In this regard, it is well understood in the art that certain alterations inclusive of mutations, additions, deletions, and substitutions can be made to a reference polynucleotide whereby the altered polynucleotide retains the biological function or activity of the reference polynucleotide or has increased activity in relation to the reference polynucleotide (i.e., optimized).

Polynucleotide variants include, for example, polynucleotides having at least 50% (and at least 51% to at least 99% and all integer percentages in between, e.g., 90%, 95%, or 98%) sequence identity with a reference polynucleotide sequence described herein. The terms "polynucleotide variant" and "variant" also include naturally-occurring allelic variants and orthologs.

The terms "polypeptide," "polypeptide fragment," "peptide," and "protein" are used interchangeably herein to refer to a polymer of amino acid residues and to variants and synthetic analogues of the same. Thus, these terms apply to amino acid polymers in which one or more amino acid residues are synthetic non-naturally occurring amino acids, such as a chemical analogue of a corresponding naturally occurring amino acid, as well as to naturally-occurring amino acid polymers. In certain aspects, polypeptides may include enzymatic polypeptides, or "enzymes," which typically catalyze (i.e., increase the rate of) various chemical reactions.

The term "polypeptide variant" refers to polypeptides that are distinguished from a reference polypeptide sequence by the addition, deletion, or substitution of at least one amino acid residue. In certain embodiments, a polypeptide variant is distinguished from a reference polypeptide by one or more substitutions, which may be conservative or non-conservative. In certain embodiments, the polypeptide variant comprises conservative substitutions and, in this regard, it is well understood in the art that some amino acids may be changed to others with broadly similar properties without changing the nature of the activity of the polypeptide. Polypeptide variants also encompass polypeptides in which one or more amino acids have been added or deleted or replaced with different amino acid residues.

The term "promoter" refers to a DNA sequence recognized by the synthetic machinery of the cell or introduced synthetic machinery, required to initiate the specific transcription of a polynucleotide sequence. The term "expression control (regulatory) sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize promoters, polyadenylation signals, and enhancers.

The term "bind," "binds," or "interacts with" refers to a molecule recognizing and adhering to a second molecule in a sample or organism but does not substantially recognize or adhere to other structurally unrelated molecules in the sample. The term "specifically binds," as used herein with respect to an antibody, refers to an antibody which recognizes a specific antigen, but does not substantially recognize or bind other molecules in a sample. For example, an antibody that specifically binds an antigen from one species may also bind that antigen from one or more species. But, such cross-species reactivity does not itself alter the classification of an antibody as specific. In another example, an antibody that specifically binds an antigen may also bind different allelic forms of the antigen. However, such cross reactivity does not itself alter the classification of an antibody as specific. In some instances, the terms "specific binding" or "specifically binding," can be used in reference to the interaction of an antibody, a protein, or a peptide with a second chemical species, to mean that the interaction is dependent upon the presence of a particular structure (e.g., an antigenic determinant or epitope) on the chemical species; for example, an antibody recognizes and binds a specific protein structure rather than to any protein. If an antibody is specific for epitope "A," the presence of a molecule containing epitope A (or free, unlabeled A), in a reaction containing labeled "A" and the antibody, will reduce the amount of labeled A bound to the antibody.

By "statistically significant," it is meant that the result was unlikely to have occurred by chance. Statistical significance can be determined by any method known in the art. Commonly used measures of significance include the p-value, which is the frequency or probability with which the observed event would occur if the null hypothesis were true. If the obtained p-value is smaller than the significance level, then the null hypothesis is rejected. In simple cases, the significance level is defined at a p-value of 0.05 or less. A "decreased" or "reduced" or "lesser" amount is typically a "statistically significant" or a physiologically significant amount, and may include a decrease that is about 1.1, 1.2, 1.3, 1.4, 1.5, 1.6 1.7, 1.8, 1.9, 2, 2.5, 3, 3.5, 4, 4.5, 5, 6, 7, 8, 9, 10, 15, 20, 30, 40, or 50 or more times (e.g., 100, 500, 1000 times) (including all integers and decimal points in between and above 1, e.g., 1.5, 1.6, 1.7. 1.8, etc.) an amount or level described herein.

The term "stimulation," refers to a primary response induced by binding of a stimulatory molecule (e.g., a TCR/CD3 complex) with its cognate ligand thereby mediating a signal transduction event, such as signal transduction via the TCR/CD3 complex. Stimulation can mediate altered expression of certain molecules, such as downregulation of TGF-β, and/or reorganization of cytoskeletal structures.

The term "stimulatory molecule" refers to a molecule on a T cell that specifically binds a cognate stimulatory ligand present on an antigen presenting cell. For example, a functional signaling domain derived from a stimulatory molecule is the zeta chain associated with the T cell receptor complex. The stimulatory molecule includes a domain responsible for signal transduction.

The term "stimulatory ligand" refers to a ligand that when present on an antigen presenting cell (e.g., an APC, a dendritic cell, a B-cell, and the like.) can specifically bind with a cognate binding partner (referred to herein as a "stimulatory molecule") on a cell, for example a T cell, thereby mediating a primary response by the T cell, including activation, initiation of an immune response, proliferation, and similar processes. Stimulatory ligands are well-known in the art and encompass, inter alia, an MHC Class I molecule loaded with a peptide, an anti-CD3 antibody, a superagonist anti-CD28 antibody, and a superagonist anti-CD2 antibody.

The term "therapeutic" refers to a treatment and/or prophylaxis. A therapeutic effect is obtained by suppression, remission, or eradication of a disease state or alleviating the symptoms of a disease state.

The term "therapeutically effective amount" refers to the amount of the subject compound that will elicit the biological or medical response of a tissue, system, or subject that is being sought by the researcher, veterinarian, medical doctor or another clinician. The term "therapeutically effective amount" includes that amount of a compound that, when administered, is sufficient to prevent the development of, or alleviate to some extent, one or more of the signs or symptoms of the disorder or disease being treated. The therapeutically effective amount will vary depending on the compound, the disease and its severity and the age, weight, etc., of the subject to be treated.

The term "treat a disease" refers to the reduction of the frequency or severity of at least one sign or symptom of a disease or disorder experienced by a subject.

The term "transfected" or "transformed" or "transduced" refers to a process by which an exogenous nucleic acid is transferred or introduced into the host cell. A "transfected" or "transformed" or "transduced" cell is one which has been transfected, transformed, or transduced with exogenous nucleic acid. The cell includes the primary subject cell and its progeny.

The term "vector" refers to a polynucleotide that comprises an isolated nucleic acid and which can be used to deliver the isolated nucleic acid to the interior of a cell. Numerous vectors are known in the art including linear polynucleotides, polynucleotides associated with ionic or amphiphilic compounds, plasmids, and viruses. Thus, the term "vector" includes an autonomously replicating plasmid or a virus. The term also includes non-plasmid and non-viral compounds which facilitate the transfer of nucleic acid into cells, such as, for example, polylysine compounds, liposomes, and the like. Examples of viral vectors include adenoviral vectors, adeno-associated virus vectors, retroviral vectors, and others. For example, lentiviruses are complex retroviruses, which, in addition to the common retroviral genes gag, pol, and env, contain other genes with regulatory or structural function. Lentiviral vectors are well known in the art. Some examples of lentivirus include the Human Immunodeficiency Viruses: HIV-1, HIV-2, and the Simian Immunodeficiency Virus: SIV. Lentiviral vectors have been generated by multiply attenuating the HIV virulence genes, for example, the genes env, vif, vpr, vpu, and nef are deleted making the vector biologically safe.

Ranges: throughout this disclosure, various aspects of the disclosure can be presented in a range format. It should be understood that the description in range format is merely for convenience and brevity and should not be construed as an inflexible limitation on the scope of the disclosure. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 2.7, 3, 4, 5, 5.3, and 6. This applies regardless of the breadth of the range.

A "chimeric antigen receptor" (CAR) molecule is a recombinant polypeptide including at least an extracellular domain, a transmembrane domain and a cytoplasmic domain or intracellular domain. In embodiments, the domains of the CAR are on the same polypeptide chain, for example a chimeric fusion protein. In embodiments, the domains are on different polypeptide chains, for example the domains are not contiguous.

The extracellular domain of a CAR molecule includes an antigen binding domain. The antigen binding domain is for expanding and/or maintaining the modified cells, such as a CAR T cell or for killing a tumor cell, such as a solid tumor. In embodiments, the antigen binding domain for expanding and/or maintaining modified cells binds an antigen, for example, a cell surface molecule or marker, on the surface of a WBC. In embodiments, the WBC is at least one of GMP (granulocyte macrophage precursor), MDP (monocyte-macrophage/dendritic cell precursors), cMoP (common monocyte precursor), basophil, eosinophil, neutrophil, SatM (Segerate-nucleus-containing atypical monocyte), macrophage, monocyte, CDP (common dendritic cell precursor), cDC (conventional DC), pDC (plasmacytoid DC), CLP (common lymphocyte precursor), B cell, ILC (Innate Lymphocyte), NK cell, megakaryocyte, myeloblast, pro-myelocyte, myelocyte, meta-myelocyte, band cells, lymphoblast, prolymphocyte, monoblast, megakaryoblast, promegakaryocyte, megakaryocyte, platelets, or MSDC (Myeloid-derived suppressor cell). In embodiments, the WBC is a granulocyte, monocyte and or lymphocyte. In embodiments, the WBC is a lymphocyte, for example, a B cell. In embodiments, the WBC is a B cell. In embodiments, the cell surface molecule of a B cell includes CD19, CD22, CD20, BCMA, CD5, CD7, CD2, CD16, CD56, CD30, CD14, CD68, CD11b, CD18, CD169, CD1c, CD33, CD38, CD138, or CD13. In embodiments, the cell surface molecule of the B cell is CD19, CD20, CD22, or BCMA. In embodiments, the cell surface molecule of the B cell is CD19.

The cells described herein, including modified cells such as CAR cells and modified T cells can be derived from stem cells. Stem cells may be adult stem cells, embryonic stem cells, more particularly non-human stem cells, cord blood stem cells, progenitor cells, bone marrow stem cells, induced pluripotent stem cells, totipotent stem cells or hematopoietic stem cells. A modified cell may also be a dendritic cell, a NK-cell, a B-cell or a T cell selected from the group consisting of inflammatory T-lymphocytes, cytotoxic T-lymphocytes, regulatory T lymphocytes or helper T-lymphocytes. In embodiments, Modified cells may be derived from the group consisting of CD4+ T lymphocytes and CD8+ T lymphocytes. Prior to expansion and genetic modification of the cells of the invention, a source of cells may be obtained from a subject through a variety of non-limiting methods. T cells may be obtained from a number of non-limiting sources, including peripheral blood mononuclear cells, bone marrow, lymph node tissue, cord blood, thymus tissue, tissue from a site of infection, ascites, pleural effusion, spleen tissue, and tumors. In certain embodiments of the present invention, any number of T cell lines available and known to those skilled in the art, may be used. In embodiments, modified cells may be derived from a healthy donor, from a patient diagnosed with cancer or from a patient diagnosed with an infection. In embodiments, a modified cell is part of a mixed population of cells which present different phenotypic characteristics.

A population of cells refers to a group of two or more cells. The cells of the population could be the same, such that the population is a homogenous population of cells. The cells of the population could be different, such that the population is a mixed population or a heterogeneous population of cells. For example, a mixed population of cells could include modified cells comprising a first CAR and cells comprising a second CAR, wherein the first CAR and the second CAR bind different antigens.

The term "stem cell" refers to any of certain types of cell which have the capacity for self-renewal and the ability to differentiate into other kind(s) of cell. For example, a stem cell gives rise either to two daughter stem cells (as occurs in vitro with embryonic stem cells in culture) or to one stem cell and a cell that undergoes differentiation (as occurs e.g. in hematopoietic stem cells, which give rise to blood cells). Different categories of stem cells may be distinguished on the basis of their origin and/or on the extent of their capacity for differentiation into other types of cell. For example, stem cells may include embryonic stem (ES) cells (i.e., pluripotent stem cells), somatic stem cells, induced pluripotent stem cells, and any other types of stem cells.

The pluripotent embryonic stem cells are found in the inner cell mass of a blastocyst and have an innate capacity for differentiation. For example, pluripotent embryonic stem cells have the potential to form any type of cell in the body. When grown in vitro for long periods of time, ES cells maintain pluripotency as progeny cells retain the potential for multilineage differentiation.

Somatic stem cells can include fetal stem cells (from the fetus) and adult stem cells (found in various tissues, such as bone marrow). These cells have been regarded as having a capacity for differentiation that is lower than that of the pluripotent ES cells—with the capacity of fetal stem cells being greater than that of adult stem cells. Somatic stem cells apparently differentiate into only a limited number of types of cells and have been described as multipotent. The "tissue-specific" stem cells normally give rise to only one type of cell. For example, embryonic stem cells may be differentiated into blood stem cells (e.g., Hematopoietic stem cells (HSCs)), which may be further differentiated into various blood cells (e.g., red blood cells, platelets, white blood cells, etc.).

Induced pluripotent stem cells (i.e., iPS cells or iPSCs) may include a type of pluripotent stem cell artificially derived from a non-pluripotent cell (e.g., an adult somatic cell) by inducing an expression of specific genes. Induced pluripotent stem cells are similar to natural pluripotent stem cells, such as embryonic stem (ES) cells, in many aspects, such as the expression of certain stem cell genes and proteins, chromatin methylation patterns, doubling time, embryoid body formation, teratoma formation, viable chimera formation, and potency and differentiability. Induced pluripotent cells can be obtained from adult stomach, liver, skin, and blood cells.

In embodiments, the antigen binding domain for killing a tumor, binds an antigen on the surface of a tumor, for example a tumor antigen or tumor marker. Tumor antigens are proteins that are produced by tumor cells that elicit an immune response, particularly T cell mediated immune responses. Tumor antigens are well known in the art and include, for example, tumor associated MUC1 (tMUC1), a glioma-associated antigen, carcinoembryonic antigen (CEA), β-human chorionic gonadotropin, alphafetoprotein (AFP), lectin-reactive AFP, thyroglobulin, RAGE-1, MN-CA IX, human telomerase reverse transcriptase, RU1, RU2 (AS), intestinal carboxyl esterase, mut hsp70-2, M-CSF, prostase, prostate-specific antigen (PSA), PAP, NY-ESO-1, LAGE-1a, p53, prostein, PSMA, Her2/neu, surviving, telomerase, prostate-carcinoma tumor antigen-1 (PCTA-1), MAGE, ELF2M, neutrophil elastase, ephrinB2, CD22, insulin growth factor (IGF)-I, IGF-II, IGF-I receptor, CD19, and mesothelin. For example, when the tumor antigen is CD19, the CAR thereof can be referred to as CD19 CAR or 19CAR, which is a CAR molecule that includes an antigen binding domain that binds CD19.

In embodiments, the extracellular antigen binding domain of a CAR includes at least one scFv or at least a single domain antibody. As an example, there can be two scFvs on a CAR. The scFv includes a light chain variable (VL) region and a heavy chain variable (VH) region of a target antigen-specific monoclonal antibody joined by a flexible linker. Single chain variable region fragments can be made by linking light and/or heavy chain variable regions by using a short linking peptide (Bird et al., Science 242:423-426, 1988). An example of a linking peptide is the GS linker having the amino acid sequence $(GGGGS)_3$ (SEQ ID NO: 124), which bridges approximately 3.5 nm between the carboxy terminus of one variable region and the amino terminus of the other variable region. Linkers of other sequences have been designed and used (Bird et al., 1988, supra). In general, linkers can be short, flexible polypeptides and preferably comprised of about 20 or fewer amino acid residues. The single chain variants can be produced either recombinantly or synthetically. For synthetic production of scFv, an automated synthesizer can be used. For recombinant production of scFv, a suitable plasmid containing polynucleotide that encodes the scFv can be introduced into a suitable host cell, either eukaryotic, such as yeast, plant, insect or mammalian cells, or prokaryotic, such as *E. coli*. Polynucleotides encoding the scFv of interest can be made by routine manipulations such as ligation of polynucleotides. The resultant scFv can be isolated using standard protein purification techniques known in the art.

The cytoplasmic domain of the CAR molecules described herein includes one or more co-stimulatory domains and one or more signaling domains. The co-stimulatory and signaling domains function to transmit the signal and activate molecules, such as T cells, in response to antigen binding. The one or more co-stimulatory domains are derived from stimulatory molecules and/or co-stimulatory molecules, and the signaling domain is derived from a primary signaling domain, such as the CD3 zeta domain. In embodiments, the signaling domain further includes one or more functional signaling domains derived from a co-stimulatory molecule. In embodiments, the co-stimulatory molecules are cell surface molecules (other than antigens receptors or their ligands) that are required for activating a cellular response to an antigen.

In embodiments, the co-stimulatory domain includes the intracellular domain of CD27, CD28, 4-1BB, OX40, CD30, CD40, PD-1, ICOS, lymphocyte function-associated antigen-1 (LFA-1), CD2, CD7, LIGHT, NKG2C, B7-H3, a ligand that specifically binds with CD83, or any combination thereof. In embodiments, the signaling domain includes a CD3 zeta domain derived from a T cell receptor.

The CAR molecules described herein also include a transmembrane domain. The incorporation of a transmembrane domain in the CAR molecules stabilizes the molecule. In embodiments, the transmembrane domain of the CAR molecules is the transmembrane domain of a CD28 or 4-1BB molecule.

Between the extracellular domain and the transmembrane domain of the CAR, there may be incorporated a spacer domain. As used herein, the term "spacer domain" generally means any oligo- or polypeptide that functions to link the transmembrane domain to the extracellular domain and/or the cytoplasmic domain on the polypeptide chain. A spacer domain may include up to 300 amino acids, preferably 10 to 100 amino acids, and most preferably 25 to 50 amino acids.

The present disclosure describes a method for in vitro cell preparation, the method comprising: preparing cells; contacting the cells with (1) a first vector comprising a polynucleotide encoding a first antigen binding molecule that binds a first antigen and (2) a second vector comprising a polynucleotide encoding a second antigen binding molecule that binds a second antigen to obtain a population of modified cells, wherein the first antigen is different from the second antigen.

The present disclosure also describes a method for enhancing cell expansion in a subject having cancer, the method comprising: obtaining cells from the subject or a healthy donor; contacting the cells with (1) a first vector comprising a polynucleotide encoding a first antigen binding molecule that binds a first antigen and (2) a second vector comprising a polynucleotide encoding a second antigen binding molecule that binds a second antigen to obtain a population of modified cells; and administering an effective amount of modified cells to the subject, wherein: the first antigen is different from the second antigen; and the level of cell expansion in the subject is higher than the level of cell expansion in a subject administered with an effective amount of cells that have been contacted with the first vector but not the second vector.

The present disclosure also describes a method for treating a subject having cancer, the method comprising: obtaining cells from the subject or a healthy donor; contacting the cells with (1) a first vector comprising a polynucleotide encoding a first antigen binding molecule that binds a first antigen and (2) a second vector comprising a polynucleotide encoding a second antigen binding molecule that binds a second antigen to obtain a population of modified cells; and administering an effective amount of modified cells to the subject, wherein: the first antigen is different form the second antigen.

The present disclosure also describes a method for enhancing treatment of a subject having cancer, the method comprising: obtaining cells from the subject or a healthy donor; contacting the cells with (1) a first vector comprising a polynucleotide encoding a first antigen binding molecule that binds a first antigen and (2) a second vector comprising a polynucleotide encoding a second antigen binding molecule that binds a second antigen to obtain a population of modified cells; and administering an effective amount of modified cells to the subject, wherein: the first antigen is different from the second antigen; and the level of inhibition of tumor growth by the effective amount of modified cells is higher than the level of inhibition of tumor growth by the effective amount of cells that have been contacted with the second vector but not the first vector.

The present disclosure also describes a method for in vitro cell preparation, the method comprising: introducing a first vector comprising a polynucleotide encoding a first antigen binding molecule that binds a first antigen into a first population of cells; introducing a second vector comprising a polynucleotide encoding a second antigen binding molecule that binds a second antigen into a second population of cells; and culturing the first and second population of cells, wherein the first antigen is different from the second antigen.

The present disclosure also describes a method for enhancing cell expansion in a subject having cancer, the method comprising: introducing a first vector comprising a polynucleotide encoding a first antigen binding molecule that binds a first antigen into a first population of cells to obtain a first population of modified cells; introducing a second vector comprising a polynucleotide encoding a second antigen binding molecule that binds a second antigen into a second population of cells to obtain a second population of modified cells; and administering an effective amount of the first and second population of modified cells to the subject, wherein: the first antigen is different from the second antigen; and the level of cell expansion in the subject is higher than the level of cell expansion in a subject administered an effective amount of the second population of modified cells but not the first population of modified cells.

The present disclosure also describes a method for treating a subject having cancer, the method comprising: introducing a first vector comprising a polynucleotide encoding a first antigen binding molecule that binds a first antigen into a first population of cells to obtain a first population of modified cells; introducing a second vector comprising a polynucleotide encoding a second antigen binding molecule that binds a second antigen into a second population of cells to obtain a second population of modified cells; and administering an effective amount of the first and second population of modified cells to the subject, wherein: the first antigen is different from the second antigen.

The present disclosure also describes a method for enhancing treatment of a subject having cancer, the method comprising: introducing a first vector comprising a polynucleotide encoding a first antigen binding molecule that binds a first antigen into a first population of cells to obtain a first population of modified cells; introducing a second vector comprising a polynucleotide encoding a second antigen binding molecule that binds a second antigen into a second population of cells to obtain a second population of modified cells; and administering an effective amount of the first and second population of modified cells to the subject, wherein: the first antigen is different from the second antigen; and the level of inhibition of tumor growth in the subject by the effective amount of first population of modified cells is higher than the level of inhibition of tumor growth in the subject by the effective amount of the second population of modified cells that is not administered the first population of modified cells.

The present disclosure also describes a method for enhancing T cell response, the method comprising: introducing a first vector comprising a polynucleotide encoding a first antigen binding molecule that binds a first antigen into a first population of cells; introducing a second vector comprising a polynucleotide encoding a second antigen binding molecule that binds a second antigen into a second population of cells; contacting cells expressing the second antigen with the first population of cells and the second population of cells; and measuring a level of the T cell response, wherein the level is higher than a level of the T cell response in response to the cells contacted with the second population of cells without the first population.

The present disclosure also describes a method for enhancing T cell response, the method comprising: contacting a population of cells with a first vector comprising a polynucleotide encoding a first antigen binding molecule that binds a first antigen and a second vector comprising a polynucleotide encoding a second antigen binding molecule that binds a second antigen to obtain a population of modified cells; contacting cells expressing the second antigen with a population of modified cells; and measuring the level of the T cell response, wherein the level of T cell response is higher than the level of T cell response in cells contacted with the population of cells that have been contacted with the second vector but not the first vector.

The cells include macrophages, dendritic cells, or lymphocytes such as T cells or NK cells. In embodiments, the cells are T cells. In embodiments, the first antigen binding molecule binds a cell surface molecule of a WBC. In embodiments, the WBC is a granulocyte, a monocyte, or lymphocyte. In embodiments, the WBC is a B cell. In embodiments, the cell surface molecule of the WBC is CD19, CD22, CD20, BCMA, CD5, CD7, CD2, CD16, CD56, CD30, CD14, CD68, CD11b, CD18, CD169, CD1c, CD33, CD38, CD138, or CD13. In embodiments, the cell surface molecule of the WBC is CD19, CD20, CD22, or BCMA. In embodiments, the cell surface molecule of the WBC is CD19.

In embodiments, the second antigen binding molecule binds a solid tumor antigen. In embodiments, the solid tumor antigen is tumor associated MUC1 (tMUC1), PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, CLDN 18.2, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Ra2, Mesothelin, PSMA, ROR1, VEGFR-II, GD2, FR-α, ErbB2, EpCAM, EGFRvIII, or EGFR.

In embodiments, the first and second binding molecules are CARs. In embodiments, the CAR comprises an extracellular domain, a transmembrane domain, and an intracellular domain, and the extracellular domain binds a tumor antigen. In embodiments, the intracellular domain comprising a co-stimulatory domain comprises an intracellular domain of a co-stimulatory molecule selected from the group consisting of CD27, CD28, 4-1BB, OX40, CD30, CD40, PD-1, ICOS, lymphocyte function-associated antigen-1 (LFA-1), CD2, CD7, LIGHT, NKG2C, B7-H3, and any combination thereof. In embodiments, the intracellular domain comprises a CD3 zeta signaling domain.

In embodiments, the first binding molecule is a CAR, and the second binding molecule is TCR. In embodiments, the T cell comprises a modified T Cell Receptor (TCR). In embodiments, the TCR is derived from spontaneously occurring tumor-specific T cells in patients. In embodiments, the TCR binds a tumor antigen. In embodiments, the tumor antigen comprises CEA, gp100, MART-1, p53, MAGE-A3, or NY-ESO-1. In embodiments, the TCR comprises TCRγ and TCRδ chains, or TCRα and TCRβ chains, or a combination thereof.

In embodiments, the second population of cells are derived from tumor-infiltrating lymphocytes (TILs). In embodiments, a T cell clone that expresses a TCR with a high affinity for the target antigen may be isolated. TILs or peripheral blood mononuclear cells (PBMCs) can be cultured in the presence of antigen-presenting cells (APCs) pulsed with a peptide representing an epitope known to elicit a dominant T cell response when presented in the context of a defined HLA allele. High-affinity clones may be then selected on the basis of MHC-peptide tetramer staining and/or the ability to recognize and lyse target cells pulsed with low titrated concentrations of cognate peptide antigen.

After the clone has been selected, the TCRα and TCRβ chains or TCRγ and TCRo chains are identified and isolated by molecular cloning. For example, for TCRα and TCRβ chains, the TCRα and TCRβ gene sequences are then used to generate an expression construct that ideally promotes stable, high-level expression of both TCR chains in human T cells. The transduction vehicle, for example, a gammaretrovirus or lentivirus, can then be generated and tested for functionality (antigen specificity and functional avidity) and used to produce a clinical lot of the vector. An aliquot of the final product can then be used to transduce the target T cell population (generally purified from patient PBMCs), which is expanded before infusion into the patient.

Various methods may be implemented to obtain genes encoding tumor-reactive TCR. More information is provided in Kershaw et al., Clin Transl Immunology. 2014 May; 3(5): e16. In embodiments, specific TCR can be derived from spontaneously occurring tumor-specific T cells in patients. Antigens included in this category include the melanocyte differentiation antigens MART-1 and gp100, as well as the MAGE antigens and NY-ESO-1, with expression in a broader range of cancers. TCRs specific for viral-associated malignancies can also be isolated, as long as viral proteins are expressed by transformed cells. Malignancies in this category include liver and cervical cancer, those associated with hepatitis and papilloma viruses, and Epstein-Barr virus-associated malignancies. In embodiments, target antigens of the TCR include CEA (e.g., for colorectal cancer), gp100, MART-1, p53 (e.g., for melanoma), MAGE-A3 (e.g., melanoma, esophageal and synovial sarcoma), and NY-ESO-1 (e.g., for nelanoma and sarcoma as well as multiple myelomas).

In embodiments, preparation and transfusion of tumor infiltrating lymphocytes (TIL) may be implemented in the following manner. For example, tumor tissue coming from surgical or biopsy specimens, can be obtained under aseptic conditions and transported to the cell culture chamber in ice box. Necrotic tissue and adipose tissue can be removed. The tumor tissue can be cut into small pieces of about 1-3 cubic millimeter. Collagenase, hyaluronidase and DNA enzyme can be added, and digested overnight at 4° C. Filtering with 0.2 μm filter, cells can be separated and collected by lymphocyte separation fluid, under 1500 rpm for 5 min. Expanding the cells in a culture medium comprising PHA, 2-mercaptoethanol, and CD3 monoclonal antibody, and a small dose of IL-2 (10-20 IU/ml) may be added to induce activation and proliferation. The cell density may be carefully measured and maintained within the range of 0.5-2× $10^6$/ml for 7-14 days at a temperature of 37° C. with 5% $CO_2$. TIL positive cells having the ability to kill homologous cancer cell can be screened out by co-culture. The TIL positive cells can be amplified in a serum-free medium containing a high dose of IL-2 (5000-6000 IU/ml) until greater than $1\times10^{11}$ TILs can be obtained. To administer TILs, they are first collected in saline using continuous-flow centrifugation and then filtered through a platelet-administration set into a volume of 200-300 mL containing 5% albumin and 450000 IU of IL-2. The TILs can be infused into patients through a central venous catheter over a period of 30-60 minutes. In embodiments, TILs can be infused in two to four separate bags, and the individual infusions can be separated by several hours.

In embodiments, the population of modified cells comprise cells comprising the first binding molecule and cells comprising the second binding molecules. In embodiments, the population of modified cells comprise cells comprising the first binding molecule, cells comprising the second binding molecules, and cells comprising both the first binding molecule and the second binding molecule.

In embodiments, the increase in T cell response is based on the increase in the number of copies of CAR(s) and/or the amount of cytokine released (e.g., IL-6 and IFN-γ. In embodiments, the T cell response comprises cytokine releases, cell expansion, and/or activation levels. In embodiments, the first vector further comprises a polynucleotide encoding IL-6 or IFNγ, or a combination thereof. In embodiments, the first vector further comprises a polynucleotide encoding IL-12. In embodiments, the polynucleotide comprises a polynucleotide encoding NFAT and/or VHL. In embodiments, the population of modified cells comprises cells expressing the first binding molecule and IL-6 or IFNγ, or a combination thereof, cells expressing the second binding molecules, cells expressing the first and second molecules, and/or cells expressing the first binding molecule and IL-12. In embodiments, the population of modified cells comprises cells expressing the second binding molecule and IL-6 or IFNγ, or a combination thereof, cells expressing the second binding molecules, cells expressing the first and second molecules, and/or cells expressing the first binding molecule and IL-12. In embodiments, the population of modified cells comprises cells expressing the second binding molecule and IL-6 or IFNγ, or a combination thereof, cells expressing the second binding molecules, cells expressing the first and second molecules, and/or cells expressing the second binding molecule and IL-12. In embodiments, the population of modified cells comprises cells expressing a dominant negative form of PD-1.

The present disclosure describes nucleic acids encoding at least two different antigen binding domains. In embodiments, there is a first antigen binding domain that binds an antigen on the surface of a WBC, and there is a second antigen binding domain that binds an antigen on a tumor that is different from the antigen on the surface of a WBC. The first antigen binding domain functions to expand the cells that it is introduced into, while the second antigen binding domain functions to inhibit the growth of or kill tumor cells containing the target tumor antigen upon binding to the target antigen. In embodiments, a nucleic acid described herein encodes both the first and second antigen binding domains on the same nucleic acid molecule. In embodiments, the two antigen binding domains are encoded by two separate nucleic acid molecules. For example, a first nucleic acid encodes a first antigen binding domain and a second nucleic acid encodes a second antigen binding domain.

In embodiments, the present disclosure describes nucleic acids encoding a first antigen binding domain of a binding molecule and a second antigen binding domain of a binding molecule, wherein the first antigen binding domain binds a cell surface molecule of a WBC, and the second antigen binding domain binds an antigen different from the cell surface molecule of the WBC. In embodiments, the first antigen binding domain binds a cell surface antigen of a B cell or a B cell marker. In embodiments, the second binding domain does not bind a B cell marker. In embodiments, the second binding domain includes a scFv comprising an amino acid sequence of SEQ ID No: 264 or 265. For example, the second antigen binding domain is on a CAR having one of the amino acid sequences of SEQ ID NOs: 271-277.

In embodiments, the first and second antigen binding domains are on two different binding molecules (first and second binding molecules) such as a first CAR and a second CAR. As an example, a first CAR includes an extracellular binding domain that binds a marker on the surface of a B cell, and a second CAR includes an extracellular binding domain that binds a target antigen of a tumor cell. In embodiments, the first CAR and second CAR are encoded by different nucleic acids. In embodiments, the first CAR and second CAR are two different binding molecules but are encoded by a single nucleic acid.

In embodiments, the two different antigen binding domains can be on the same binding molecule, for example on a bispecific CAR, and encoded by a single nucleic acid. In embodiments, the bispecific CAR can have two different scFv molecules joined together by linkers. Examples of the bispecific CAR are provided in Table 2.

Figure 5:
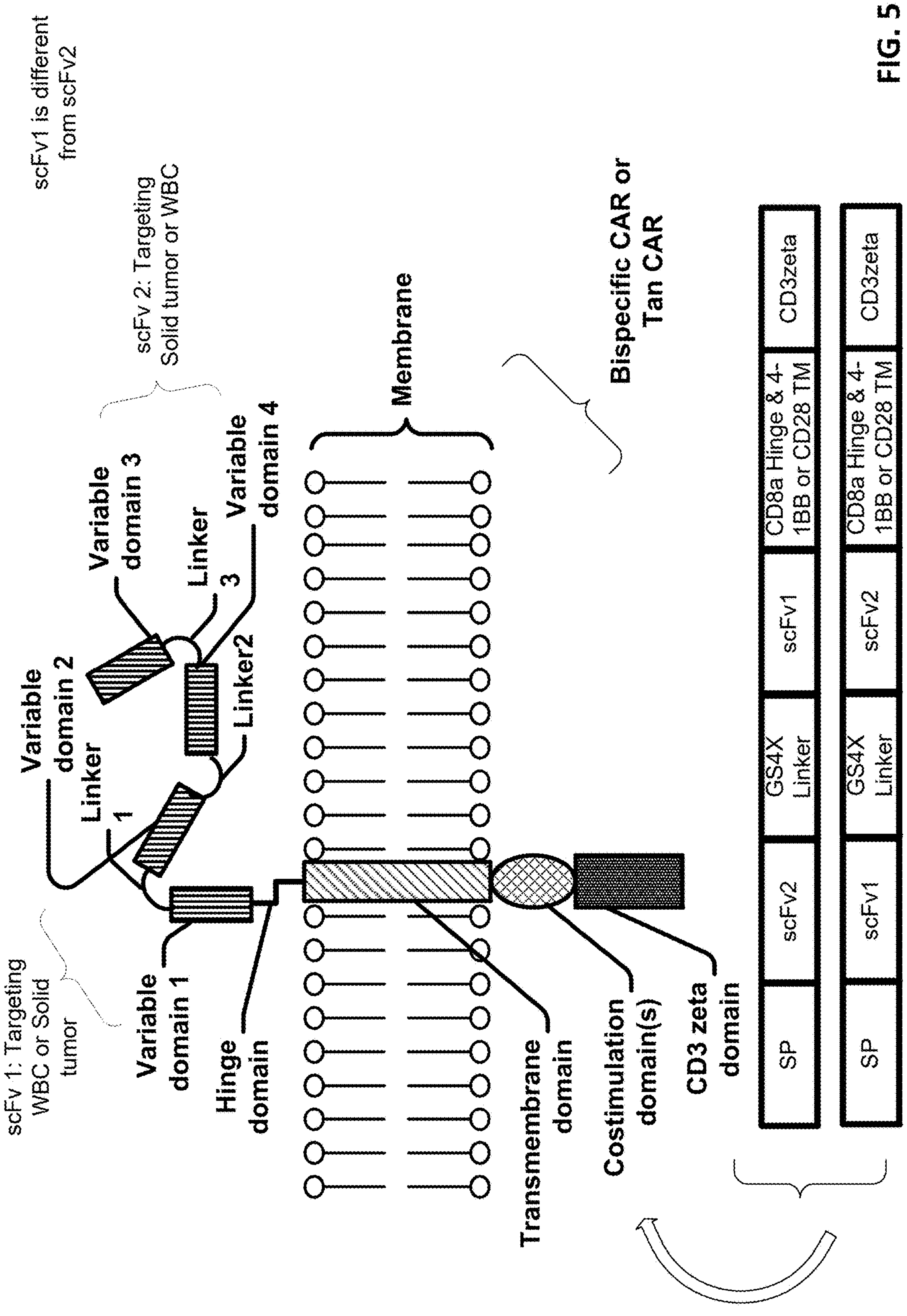
FIG. 5 is a schematic diagram showing an exemplary portion of a cell membrane comprising a bispecific CAR molecule.
Figure 6:
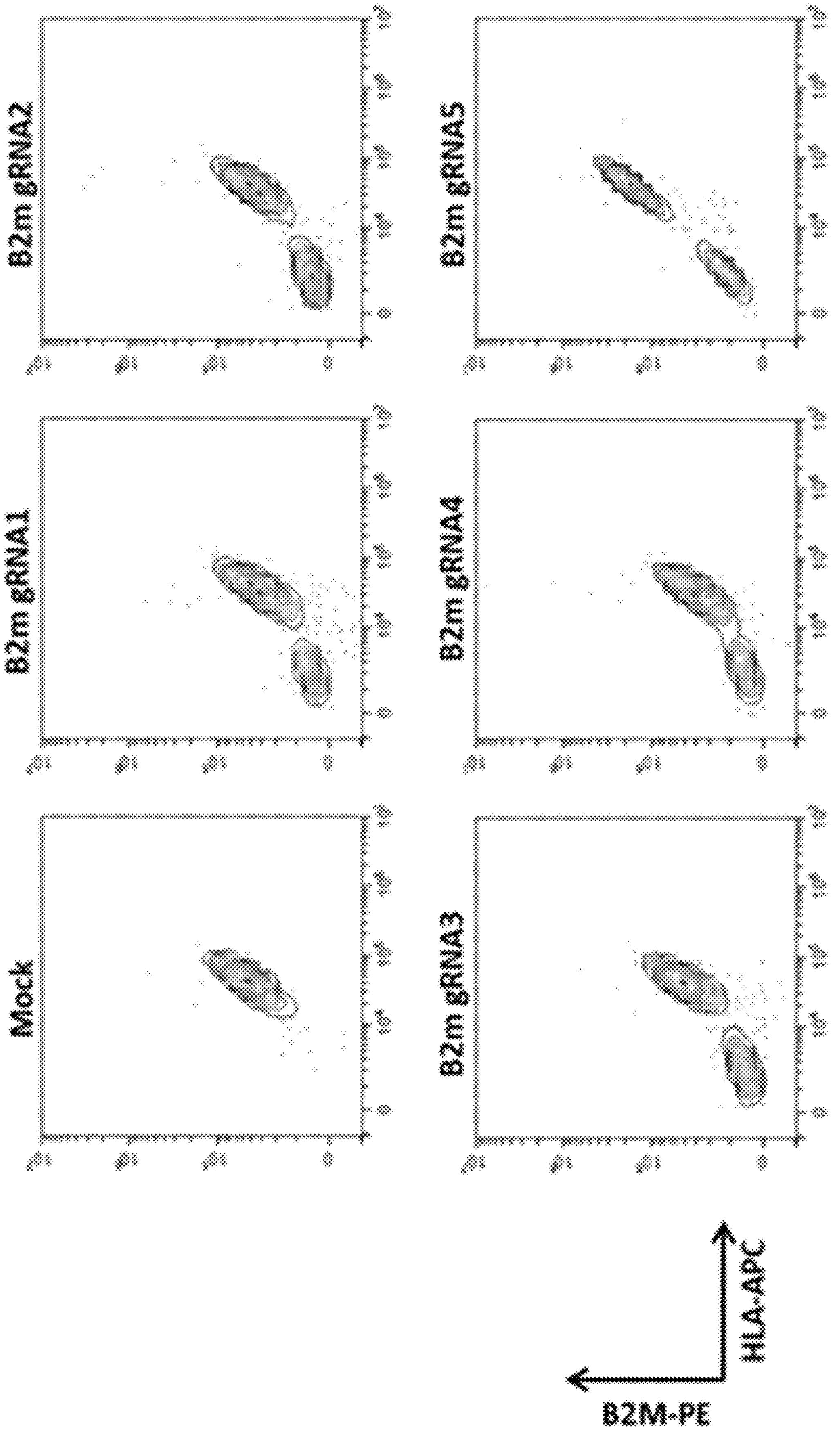
FIG. 6 shows cytokine data of peripheral blood samples from mice.

An example of a bispecific CAR is shown in FIG. 5. As shown in FIG. 5, a bispecific CAR (or tandem CAR (tanCAR)) may include two binding domains: scFv1 and scFv2. In embodiments, scFv1 binds an antigen of a white blood cell (e.g., CD19), and scFv2 binds a solid tumor antigen (e.g., tMUC1). In embodiments, scFv1 binds a solid tumor antigen, and scFv2 binds another solid tumor antigen (e.g., tMUC1 and CLDN 18.2). Claudin18.2 (CLDN 18.2) is a stomach-specific isoform of Claudin-18. CLDN 18.2 is highly expressed in gastric and pancreatic adenocarcinoma. In embodiments, scFv1 binds an antigen expressed on tumor cells but not on normal tissues (e.g., tMUC1); scFv2 binds an antigen expressed on nonessential tissues associated with solid tumor; and the killing of normal cells of the tissue does not cause a life-threatening event (e.g., complications) to the subject (e.g., TSHR, GUCY2C). Examples of the nonessential tissues include organs such as prostate, breast, or melanocyte. In embodiments, scFv1 and scFv2 bind to different antigens that expressed on the same nonessential tissue (e.g., ACPP and SLC45A3 for Prostate cancer, and SIGLEC15 and UPK2 for Urothelial cancer). The sequences of the bispecific CARs and their components may be found in Table 5.

TABLE 2

| Variable domain 1 | Linker 1 | Variable domain 3 | Linker 2 | Variable domain 5 | Linker3 | Variable domain 7 |
|---|---|---|---|---|---|---|
| Anti-TSHR-VL | 3*GGGGS linker | Anti-TSHR-VH | 4*GGGGS bispecific CAR linker | humanized-anti CD19-VH | 3*GGGGS linker | humanized-anti CD19-VL |
| Anti-TSHR-VH | 3*GGGGS linker | Anti-TSHR-VL | 4*GGGGS bispecific CAR linker | humanized-anti CD19-VL | 3*GGGGS linker | humanized-anti CD19-VH |
| Tumor associated MUC1 scFv-1 or 2 VL | 3*GGGGS linker | Tumor associated MUC1 scFv-1 or 2 VH | 4*GGGGS bispecific CAR linker | anti CD19-VL | 3*GGGGS linker | anti CD19-VH |
| Tumor associated MUC1 scFv-1 or 2 VH | 3*GGGGS linker | Tumor associated MUC1 scFv-1 or 2 VL | 4*GGGGS bispecific CAR linker | anti CD19-VH | 3*GGGGS linker | anti CD19-VL |
| humanized-anti CD19-VH | 3*GGGGS linker | humanized-anti CD19-VL | 4*GGGGS bispecific CAR linker | Tumor associated MUC1 scFv-1 or 2 VL | 3*GGGGS linker | Tumor associated MUC1 scFv-1 or 2 VH |
| Tumor associated MUC1 scFv-1 or 2 VL | 3*GGGGS linker | Tumor associated MUC1 scFv-1 or 2 VH | 4*GGGGS bispecific CAR linker | Anti-TSHR-VL | 3*GGGGS linker | Anti-TSHR-VH |
| Anti-TSHR-VL | 3*GGGGS linker | Anti-TSHR-VH | 4*GGGGS bispecific CAR linker | Tumor associated MUC1 scFv-1 or 2 VL | 3*GGGGS linker | Tumor associated MUC1 scFv-1 or 2 VH |
| Tumor associated MUC1 scFv-1 or 2 VL | 3*GGGGS linker | Tumor associated MUC1 scFv-1 or 2 VH | 4*GGGGS bispecific CAR linker | Anti-GUCY2C-VH or VL | 3*GGGGS linker | Anti-GUCY2C-VL or VH |
| Anti-GUCY2C-VH or VL | 3*GGGGS linker | Anti-GUCY2C-VL or VH | 4*GGGGS bispecific CAR linker | Tumor associated MUC1 scFv-1 or 2 VL | 3*GGGGS linker | Tumor associated MUC1 scFv-1 or 2 VH |

TABLE 2-continued

| Variable domain 1 | Linker 1 | Variable domain 3 | Linker 2 | Variable domain 5 | Linker3 | Variable domain 7 |
|---|---|---|---|---|---|---|
| Tumor associated MUC1 scFv-1 or 2 VL | 3*GGGGS linker | Tumor associated MUC1 scFv-1 or 2 VH | 4*GGGGS bispecific CAR linker | Anti-ACPP-VH or VL | 3*GGGGS linker | Anti- ACPP-VL or VH |
| Anti-ACPP-VH or VL | 3*GGGGS linker | Anti- ACPP-VL or VH | 4*GGGGS bispecific CAR linker | Tumor associated MUC1 scFv-1 or 2 VL | 3*GGGGS linker | Tumor associated MUC1 scFv-1 or 2 VH |
| Tumor associated MUC1 scFv-1 or 2 VL | 3*GGGGS linker | Tumor associated MUC1 scFv-1 or 2 VH | 4*GGGGS bispecific CAR linker | Anti-CLDN18.2-VH or VL | 3*GGGGS linker | Anti-CLDN18.2-VL or VH |
| Anti-CLDN18.2-VH or VL | 3*GGGGS linker | Anti-CLDN18.2-VL or VH | 4*GGGGS bispecific CAR linker | Tumor associated MUC1 scFv-1 or 2 VL | 3*GGGGS linker | Tumor associated MUC1 scFv-1 or 2 VH |
| Tumor associated MUC1 scFv-1 or 2 VL | 3*GGGGS linker | Tumor associated MUC1 scFv-1 or 2 VH | 4*GGGGS bispecific CAR linker | Anti-UPK2-VH or VL | 3*GGGGS linker | Anti- UPK2-VL or VH |
| Anti-UPK2-VH or VL | 3*GGGGS linker | Anti- UPK2-VL or VH | 4*GGGGS bispecific CAR linker | Tumor associated MUC1 scFv-1 or 2 VL | 3*GGGGS linker | Tumor associated MUC scFv-1 or 2 VH |
| Tumor associated MUC1 scFv-1 or 2 VL | 3*GGGGS linker | Tumor associated MUC1 scFv-1 or 2 VH | 4*GGGGS bispecific CAR linker | Anti-SIGLEC15-VH or VL | 3*GGGGS linker | Anti-SIGLEC15-VL or VH |
| Anti-SIGLEC15-VH or VL | 3*GGGGS linker | Anti-SIGLEC15-VL or VH | 4*GGGGS bispecific CAR linker | Tumor associated MUC1 scFv-1 or 2 VL | 3*GGGGS linker | Tumor associated MUC1 scFv-1 or 2 VH |

3*(GGGGS) is $(GGGGS)_3$ (SEQ ID NO: 124) and 4*(GGGGS) is $(GGGGS)_4$. (SEQ ID NO: 431)

In embodiments, the two different antigen binding domains can be on a CAR and a T cell receptor (TCR) and are encoded by separate nucleic acids. The binding domain of a TCR can target a specific tumor antigen or tumor marker on the cell of a tumor. In embodiments the TCR binding domain is a TCR alpha binding domain or TCR beta binding domain that targets a specific tumor antigen. In embodiments, the TCR comprises the TCRγ and TCRo chains or the TCRα and TCRβ chains.

The present disclosure also describes vectors including the nucleic acids described herein. In embodiments, a single vector contains the nucleic acid encoding the first CAR and second CAR or TCR (containing the second antigen binding domain). In embodiments, a first vector contains the first nucleic acid encoding a first CAR, and a second vector contains the nucleic acid encoding the second CAR or TCR. In embodiments, the vector includes the nucleic acid encoding a bispecific CAR including at least the two different antigen binding domains. In embodiments, the vectors including the nucleic acids described herein are lentiviral vectors.

Moreover, the present disclosure describes modified cells comprising the nucleic acids or vectors described herein. The cells have been introduced with the nucleic acids or vectors described herein and express at least one or more different antigen binding domains. In embodiments, the cells express one antigen binding domain. In embodiments, the cells include a first antigen binding domain and a second antigen binding domain, wherein the first antigen binding domain binds a cell surface molecule of a WBC, and the second antigen binding domain binds an antigen different from the cell surface molecule of a WBC. In embodiments, the second antigen binding domain binds a tumor antigen. In embodiments, the cells are modified T cells. In embodiments, the modified T cells are CAR T cells including one or more nucleic acids encoding a first antigen binding domain and/or a second antigen binding domain. In embodiments, the modified cells include T cells containing a TCR including the second antigen binding domain.

Further, the present disclosure describes compositions including a mixed population of the modified cells described herein. In embodiments, the modified cells include modified lymphocytes, modified dendritic cells, and modified macrophages. In embodiments, the modified lymphocytes are modified T cells or modified NK cell. In embodiments, the modified T cells are CAR T cells.

The present disclosure describes a mixed population of modified cells effective for expanding and/or maintaining the modified cells in a patient. In embodiments, examples of a mixed population of modified cells include the following: (1) a first modified cell expressing an antigen binding domain for expanding and/or maintaining the modified cells and a second modified cell expressing an antigen binding domain for killing a target cell, such as a tumor cell; (2) the modified cells of (1) and a further modified cell expressing at least two different antigen binding domains, a first antigen binding domain for expanding and/or maintaining the modified cells and a second antigen binding domain for killing a target cell (wherein the two different antigen binding domains are expressed on the same cell); (3) a modified cell expressing at least two different antigen binding domains, a first antigen binding domain for expanding and/or maintaining the modified cells and a second antigen binding domain for killing a target cell (wherein the two different antigen binding domains are expressed on the same cell); (4) a modified cell expressing an antigen binding domain for killing a target cell and a modified cell expressing at least two antigen binding domains, a first antigen binding domain for expanding and/or maintaining the modified cells and a second antigen binding domain for killing a target cell (wherein the two different antigen binding domains are expressed on the same modified cell); or (5) a modified cell expressing an antigen binding domain for expanding and/or maintaining the modified cells and a modified cell expressing at least two antigen binding domains, a first antigen binding domain for expanding and/or maintaining the modified cells and a second antigen binding domain for killing a target cell (wherein the two different antigen binding domains are expressed on the same modified cell). In embodiments, the two antigen binding domains are different molecules. In embodiments, the antigen binding domain for expanding the modified cells (the first antigen binding domain) is an antigen binding domain that binds a WBC, such as a B cell, and the antigen binding domain for killing a target cell, such as tumor cell, (the second antigen binding domain) is an antigen binding domain that binds a tumor. In embodiments, the antigen binding domain binding a B cell binds the surface antigen of the B cell, for example, CD19, and the antigen binding domain binding a tumor binds an antigen of a tumor, for example tMUC1. In embodiments, the tumor cell is a solid tumor cell.

In embodiments, the mixed population of modified cells may include at least one of the following modified cells: a first modified cell expressing an antigen binding domain for expanding and/or maintaining the modified cells, a second modified cell expressing an antigen binding domain for killing a target cell, such as a tumor cell, and a third modified cell expressing both the antigen binding domain for expanding and/or maintaining the modified cells and the antigen binding domain for killing a target cell. For example, the mixed population of modified cells includes the first and second modified cells, the first and third modified cells, or the second and third modified cells. In embodiments, the first modified cell expresses a CAR binding an antigen of WBC (e.g., CD19); the second modified cell expresses a CAR or TCR binding a solid tumor antigen; and the third modified cell expresses the CAR binding the antigen of WBC and the CAR/TCR binding the solid tumor antigen. It has been reported that persistent antigen exposure can cause T cell exhaustion. Thus, a population of modified cells including the third modified cell can exhaust at a higher rate than the mixed population of modified cells. For example, the population of modified cells including the third modified cell alone can exhaust at a higher rate than the mixed population of modified cells including the first and the second modified cells in the presence of the antigen of WBC. Examples of the solid tumor antigens of TCR comprise TPO, TGM3, TDGF1, TROP2, LY6K, TNFSF13B, HEG1, LY75, HLA-G, CEACAM8, CEACAM6, EPHA2, GPRC5D, PLXDC2, HAVCR1, CLEC12A, CD79B, OR51E2, CDH17, IFITM1, MELTF, DR5, SLC6A3, ITGAM, SLC44A1, RHOC, CD109, ABCG2, ABCA10, ABCG8, 5t4, HHLA2, PRAME, CDH6, ESR1, SLC2A1, GJA5, ALPP, FGD2, PMEL, CYP19A1, MLANA, STEAP1, SSX2, PLAC1, ANKRD30A, CPA2, TTN, ZDHHC23, ARPP21, RBPMS, PAX5, MIA, CIZ1, AMACR, BAP31, IDO1, PGR, RAD51, USP17L2, OLAH, IGF2BP3, STS, IGF2, ACTA1, or CTAG1.

The mixed population of modified cells described herein includes about 1% to 10% modified cells expressing the first antigen binding domain, 50% to 60% modified cells expressing a second antigen binding domain, and about 10% modified cells expressing both the first antigen binding domain and the second antigen binding domain (wherein the first and second antigen binding domains are expressed in a single cell).

The present disclosure also describes methods of culturing cells described herein. The methods described herein include obtaining a cell comprising a first antigen binding domain and/or a second antigen binding domain, wherein the first antigen binding domain binds a cell surface molecule of a WBC, and the second antigen binding domain binds an antigen different from the cell surface molecule of the WBC; and culturing the cell in the presence of an agent derived from a cell surface molecule of the WBC or from an antigen to which the second antigen binding domain binds. In embodiments, the agent is an extracellular domain of a cell surface molecule of a WBC.

The present disclosure also describes methods of culturing mixed population of cells described herein. The methods described herein include obtaining a mixed population of cells comprising a first antigen binding domain and/or a second antigen binding domain, wherein the first antigen binding domain binds a cell surface molecule of a WBC, and the second antigen binding domain binds an antigen different from the cell surface molecule of the WBC; and culturing the cells in the presence of an agent derived from a cell surface molecule of the WBC or from an antigen to which the second antigen binding domain binds. In embodiments, the agent is an extracellular domain of a cell surface molecule of a WBC.

The present disclose describes methods for in vitro cell preparation, wherein the method includes providing cells; introducing one or more nucleic acids described herein encoding a first antigen binding domain and/or a second antigen binding domain into the cells, wherein the first antigen binding domain binds a cell surface molecule of a WBC, and the second antigen binding domain binds an antigen different from the cell surface molecule of the WBC; and culturing the cells in the presence of an agent derived from the cell surface molecule of the WBC or from an antigen to which the second antigen binding domain binds. The methods provide genetically modified cells including a first antigen binding domain, cells including a second binding domain, and cells including both the first and second antigen binding domain. The methods provide cells with single binding domains and cells expressing both antigen binding domains. The methods also provide a mixed population of cells including cells including a single binding domain and cells expressing both antigen binding domains. Additionally, the methods provide compositions including a mixed population of cells described herein.

The present disclosure describes using the prepared cell preparation, the mixed population of cells, or the compositions of mixed population of cells to enhance and maintain the T cell expansion in a subject having cancer, in order to be effective in killing the tumorigenic cells in the subject. In embodiments, the method comprises introducing a plurality of nucleic acids described herein into T cells to obtain a mixed population of modified T cells, the plurality of nucleic acids encoding a chimeric antigen receptor (CAR) or TCR binding a solid tumor antigen and/or encoding a CAR binding an antigen of a WBC; and administering an effective amount of a mixed population of modified cells to the subject, wherein examples of a mixed population of modified cells include the following: (1) T cells containing a CAR or TCR binding a solid tumor antigen and T cells containing a CAR binding an antigen of a WBC; (2) the T cells of (1) and further T cells containing both (i) a CAR or TCR binding a solid tumor antigen, and (ii) a CAR binding an antigen of a WBC (both (i) and (ii) are in a single modified T cell); (3) T cells containing both (i) the CAR or TCR binding a solid tumor antigen, and (ii) a CAR binding an antigen of a WBC (both (i) and (ii) are in a single modified T cell); (4) T cells containing a CAR or TCR binding a solid tumor antigen and T cells containing both (i) a CAR or TCR binding a solid tumor antigen and (ii) a CAR binding an antigen of a WBC (both (i) and (ii) are in a single modified T cell); or (5) T cells containing a CAR binding an antigen of a WBC and T cells containing both (i) a CAR or TCR binding a solid tumor antigen and (ii) a CAR binding an antigen of a WBC (both (i) and (ii) are in a single modified T cell). In embodiments, the WBC is a B cell. Additionally, the present disclosure describes methods for introducing and/or enhancing lymphocyte (T cell) response in a subject wherein the response is to a therapeutic agent (e.g., cytokines) or a therapy for treating the subject. Embodiments described herein involve a mechanism that expands and/or maintains the lymphocytes and a mechanism that relates to binding of a CAR to a tumor cell. In embodiments, the first mechanism involves a molecule involved in expanding and/or maintaining the lymphocytes in a subject, and an additional mechanism involves a molecule directed to inhibiting the growth of, or the killing of a tumor cell in the subject. In embodiments, the mechanisms involve signal transduction and molecules or domains of a molecules responsible for signal transduction are involved in the mechanisms described herein. For example, the first mechanism includes a CAR binding an antigen associated with blood, such as blood cells and blood plasma, or non-essential tissues, and the additional mechanism includes a CAR or TCR targeting an antigen associated with the tumor cell. Examples of non-essential tissues include the mammary gland, colon, gastric gland, ovary, blood components (such as WBC), and thyroid. In embodiments, the first mechanism involves a first antigen binding domain of a molecule, and the additional mechanism involves a second antigen binding domain of a molecule. In embodiments, the first mechanism and the additional mechanism are performed by a mixed population of modified cells. In embodiments, the mechanism involves a cell expressing an antigen associated with a tumor cell, and the additional mechanism involves a lymphocyte, such as a B cell, expressing a cell surface antigen. In embodiments, the CAR binding a solid tumor antigen is a bispecific CAR. In embodiments, the CAR binding an antigen of WBC is a bispecific CAR.

The methods described herein involves lymphocytes expressing an expansion molecule and a function molecule. In embodiments, the expansion molecule expands and/or maintains the lymphocytes in a subject, and the function molecule inhibits the growth of or kills a tumor cell in the subject. In embodiments, the expansion molecule and the function molecule are on a single CAR molecule, for example a bispecific CAR molecule. In embodiments, the expansion molecule and the function molecule are on separate molecules, for example, CAR and TCR or two different CARs. The expansion molecule can include a CAR binding to an antigen associated with blood (e.g., blood cells and blood plasma) or non-essential tissues, and the function molecule can include a CAR or TCR targeting an antigen associated with a tumor cell.

Lymphocyte or T cell response in a subject refers to cell-mediated immunity associated with a helper, killer, regulatory, and other types of T cells. For example, T cell response may include activities such as assisting other WBCs in immunologic processes and identifying and destroying virus-infected cells and tumor cells. T cell response in the subject can be measured via various indicators such as a number of virus-infected cells and/or tumor cells that T cells kill, the amount of cytokines (e.g., IL-6 and IFN-γ) that T cells release in vivo and/or in co-culturing with virus-infected cells and/or tumor cells, indicates a level of proliferation of T cells in the subject, a phenotype change of T cells, for example, changes to memory T cells, and a level longevity or lifetime of T cells in the subject.

In embodiments, the method of enhancing T cell response described herein can effectively treat a subject in need thereof, for example, a subject diagnosed with a tumor. The term tumor refers to a mass, which can be a collection of fluid, such as blood, or a solid mass. A tumor can be malignant (cancerous) or benign. Examples of blood cancers include chronic lymphocytic leukemia, acute myeloid leukemia, acute lymphoblastic leukemia, and multiple myeloma.

Solid tumors usually do not contain cysts or liquid areas. The major types of malignant solid tumors include sarcomas and carcinomas. Sarcomas are tumors that develop in soft tissue cells called mesenchymal cells, which can be found in blood vessels, bone, fat tissues, ligament lymph vessels, nerves, cartilage, muscle, ligaments, or tendon, while carcinomas are tumors that form in epithelial cells, which are found in the skin and mucous membranes. The most common types of sarcomas include undifferentiated pleomorphic sarcoma which involves soft tissue and bone cells; leiomyosarcoma which involves smooth muscle cells that line blood vessels, gastrointestinal tract, and uterus; osteosarcoma which involves bone cells, and liposarcoma which involves fat cells. Some examples of sarcomas include Ewing sarcoma, Rhabdomyosarcoma, chondosarcoma, mesothelioma, fibrosarcoma, fibrosarcoma, and glioma.

The five most common carcinomas include adrenocarcinoma which involves organs that produce fluids or mucous, such as the breasts and prostate; basal cell carcinoma which involves cells of the outer-most layer of the skin, for example, skin cancer; squamous cell carcinoma which involves the basal cells of the skin; and transitional cell carcinoma which affects transitional cells in the urinary tract which includes the bladder, kidneys, and ureter. Examples of carcinomas include cancers of the thyroid, breast, prostate, lung, intestine, skin, pancreas, liver, kidneys, and bladder, and cholangiocarcinoma.

The methods described herein can be used to treat a subject diagnosed with cancer. The cancer can be a blood cancer or can be a solid tumor, such as a sarcoma or carcinoma. The method of treating includes administering an effective amount of a mixed population of T cells described herein comprising a first antigen binding domain and/or a second antigen binding domain to the subject to provide a T-cell response, wherein the first antigen binding domain binds a cell surface molecule of a WBC, and the second antigen binding domain binds an antigen different from the cell surface molecule of the WBC. In embodiments, enhancing the T cell response in the subject includes selectively enhancing proliferation of T cell expressing the first antigen binding domain and the second antigen binding domain in vivo.

The methods for enhancing T cell response in a subject include administering to the subject T cells comprising a CAR or a bispecific CAR including two different antigen binding domains and T cells comprising a first CAR and a second CAR, wherein the first CAR and the second CAR, each includes a different antigen binding domain.

In embodiments, methods for enhancing T cell response in a subject described herein include administering to the subject T cells including a CAR molecule and a TCR molecule. The CAR molecule targets or binds a surface marker of a white blood cell, and the TCR molecule binds a marker or an antigen of the tumor that is expressed on the surface or inside the tumor cell.

In embodiments, the methods for enhancing T cell response in a subject in need thereof include administering to the subject, a mixed population of modified cells or a composition comprising a mixed population of modified cells. Examples of a mixed population of modified T cells include the following: (1) T cells containing a CAR binding an antigen of a WBC and T cells containing a CAR or TCR binding a tumor antigen; (2) the T cells of (1) and further T cells containing both (i) the CAR or TCR binding a tumor antigen, and (ii) a CAR binding an antigen of a WBC (both (i) and (ii) are in a single modified T cell); (3) T cells containing both (i) a CAR or TCR binding a tumor antigen, and (ii) a CAR binding an antigen of a WBC (both (i) and (ii) are in a single modified T cell); (4) T cells containing a CAR or TCR binding a tumor antigen and T cells containing both (i) a CAR or TCR binding a solid tumor antigen and (ii) a CAR binding an antigen of a WBC; or (5) T cells containing a CAR binding an antigen of a WBC and T cells containing both (i) a CAR or TCR binding a solid tumor antigen and (ii) the CAR binding the antigen of a WBC (both (i) and (ii) are in a single modified T cell). In embodiments, the subject is diagnosed with a solid tumor. In embodiments, the tumor antigen is a solid tumor antigen, for example tMUC1. In embodiments, the WBC is a B cell, and the antigen is a B cell antigen. In embodiments, the B cell antigen is CD19. In embodiments, the tumor antigen is tMUC1 and the antigen of a WBC is CD19.

The present disclosure describes methods of expanding and/or maintaining cells expressing an antigen binding domain in vivo. The method includes administering an effective amount of a mixed population of modified cells or a composition including a mixed population of modified cells described herein to a subject These methods described herein are useful for expanding T cells, NK cells, macrophages and/or dendritic cells.

The mixed population of modified T cells described herein include a first CAR and/or a second CAR or TCR. In embodiments, the first CAR contains a first antigen binding domain and the second CAR or TCR contains a second antigen binding domain. For example, the first CAR and the second CAR or TCR include an extracellular antigen binding domain, a transmembrane domain, and a cytoplasmic domain. The cytoplasmic domain of the first CAR and second CAR include a co-stimulatory domain and a CD3 zeta domain for transmitting signals for activation of cellular responses. In embodiments, the first CAR and second CAR or TCR are expressed on different modified T cells. In embodiments, the first CAR and second CAR or TCR are expressed on the same modified T cell.

In embodiments, in the mixed population of modified T cells described herein, the cytoplasmic domain of the first CAR, which contains an antigen binding domain for expanding and/or maintaining modified T cells, includes one or more co-stimulatory domains in the absence of a CD3 zeta domain such that activation or stimulation of the first CAR expands WBCs, such as lymphocytes, without introducing and/or activating the killing function of the modified T cells targeting the WBCs. In embodiments, the lymphocytes are T cells. In embodiments, when the cytoplasmic domain of the first CAR includes one or more co-stimulatory domains in the absence of a CD3 zeta domain, the second CAR includes a CD3 zeta domain.

In embodiments, the first and second antigen binding domains are on the same CAR (the first CAR), for example, a bispecific CAR with an extracellular antigen binding domain, a transmembrane domain, and a cytoplasmic domain. The extracellular antigen binding domain includes at least two scFvs and at least one of the scFvs function as a first antigen binding domain for binding a cell surface molecule of a WBC. In embodiments, the bispecific CAR is expressed on a modified T cell.

In embodiments, the antigen different from the cell surface molecule of the WBC is CD19, CD22, CD20, BCMA, CD5, CD7, CD2, CD16, CD56, CD30, CD14, CD68, CD11b, CD18, CD169, CD1c, CD33, CD38, CD138, CD13, B7-H3, CAIX, CD123, CD133, CD171, CD171/L1-CAM, CEA, Claudin 18.2, cMet, CS1, CSPG4, Dectin1, EGFR, EGFR vill, EphA2, ERBB receptors, ErbB T4, ERBB2, FAP, Folate receptor 1, FITC, Folate receptor 1, FSH, GD2, GPC3, HA-1 H/HLA-A2, HER2, IL-11Ra, IL13 receptor a2, IL13R, IL13Ra2 (zetakine), Kappa, Leukemia, LewisY, Mesothelin, MUC1, NKG2D, NY-ESO-1, PSMA, ROR-1, TRAIL-receptor1, or VEGFR2.

In embodiments, the MUC1 is a tumor-exclusive epitope of a human MUC1, and the first CAR and the second CAR or the TCR are expressed as separate polypeptides. In embodiments, the MUC1 is a tumor form of human MUC1 (tMUC1).

In embodiments, in the mixed population of modified cells described herein, the first CAR, which includes an antigen binding domain for expanding and/or maintaining modified cells, may include a co-stimulatory domain without a signaling domain of CD3 zeta domain, and the CAR (second CAR) may comprise the MUC1 binding domain, a transmembrane domain, a co-stimulatory, and a CD3 zeta domain.

As used herein, the term "MUC1" refers to a molecule defined as follows. MUC1 is one of the epithelial mucin family of molecules. MUC1 is a transmembrane mucin glycoprotein that is normally expressed on all glandular epithelial cells of the major organs. In normal cells, MUC1 is only expressed on the apical surface and is heavily glycosylated with its core proteins sequestered by the carbohydrates. As cells transform to a malignant phenotype, expression of MUC1 increases several folds, and the expression is no longer restricted to the apical surface, but it is found all around the cell surface and in the cytoplasm. In addition, the glycosylation of tumor associated MUC1 (tMUC1) is aberrant, with greater exposure of the peptide core than is found on MUC1 expressed in normal tissues.

MUC1 is widely expressed on a large number of epithelial cancers and is aberrantly glycosylated making it structurally and antigenically distinct from that expressed by non-malignant cells (see, e.g., Barratt-Boyes, 1996; Price et al., 1998; Peterson et al., 1991). The dominant form of MUC1 is a high molecular weight molecule comprising a large highly immunogenic extracellular mucin-like domain with a large number of twenty amino acid tandem repeats, a transmembrane region, and a cytoplasmic tail (Quin et al., 2000; McGucken et al., 1995; Dong et al., 1997).

In most epithelial adenocarcinomas including breast and pancreas, MUC1 is overexpressed and aberrantly glycosylated. Adenocarcinoma of the breast and pancreas not only overexpress MUC1 but also shed MUC1 into the circulation. High MUC1 serum levels are associated with progressive disease. MUC1 has been exploited as a prospective biomarker because of the complex and heterogeneous nature of the epitopes expressed within the antigen. MUC1 synthesized by cancerous tissues (e.g., tumor associated MUC1) usually displays an aberrant oligosaccharide profile, which gives rise to the expression of neomarkers such as sialyl-Lea (assayed in the CA19-9 test), sialyl-Lex, and sialyl-Tn (TAG-72), as well as the cryptic epitopes such as Tn.

Several antibodies are being developed against MUC1 for therapeutic use. Pemtumomab (also known as HMFG1) is in Phase III clinical trials as a carrier to deliver the radioisotope Yttrium-90 into tumors in ovarian cancer (reviewed in Scott et al., 2012). CA15-3 (also the HMFG1 antibody), CA27-29, and CA19-9 are all antibodies to MUC1 that are used to assess levels of circulating MUC1 in patients with cancer. However, these antibodies have shown limited utility as therapeutic agents or as biomarkers because they cannot distinguish effectively between MUC1 expressed on normal versus transformed tumor epithelia. In other words, none of these antibodies appear to be targeted to a tumor associated MUC1 (tMUC1) epitope.

A new antibody that is highly specific for a tumor associated form of MUC1 (tMUC1) is designated TAB-004 and is described in U.S. Pat. No. 8,518,405 (see also Curry et al., 2013). While Pemtumomab (HMFG1) was developed using human milk fat globules as the antigen (Parham et al., 1988), TAB-004 was developed using tumors expressing an altered form of MUC1 (Tinder et al., 2008). TAB-004 recognizes the altered glycosylated epitope within the MUC1 tandem repeat sequence. This area is accessible for antigenic detection in tMUC but is blocked from antigenic detection in normal MUC1 by large branches of glycosylation (Gendler, 2001; Mukherjee et al., 2003b; Hollingsworth & Swanson, 2004; Kufe, 2009). Importantly, TAB-004 is different from the epitopes recognized by other MUC1 antibody and has unique complementary determinant regions (CDRs) of the heavy and light chains. The antibody binds the target antigen with a high binding affinity at 3 ng/ml (20 μM) and does not bind unrelated antigens (Curry et al., 2013). Thus, TAB-004 distinguishes between normal and tumor form of MUC1 while HMFG1 (Pemtumomab) does not (see U.S. Pat. No. 8,518,405).

In embodiments, the first CAR comprises the first antigen binding domain, a transmembrane domain, a co-stimulatory domain, and a CD3 zeta domain, and/or the second CAR comprises the second antigen binding domain, a transmembrane domain, a co-stimulatory domain, and a CD3 zeta domain.

In embodiments, the antigen binding domain is a Fab or a scFv. In embodiments, the first CAR comprises the amino acid sequence of one of SEQ ID NO: 5, 6, and 53-58; and the second CAR comprises the amino acid sequence of one of SEQ ID NOs: 5-17, 29, 33, 37, 71, and 72, or the amino acid sequence encoded by the nucleic acid sequence of one of SEQ ID NOs: 41, 45, 63, 67, and 68. In embodiments, a nucleic acid sequence encoding the first CAR comprises the nucleic acid sequence of SEQ ID NO: 59 or 60, and a nucleic acid sequence encoding the second CAR comprises the nucleic acid sequence of SEQ ID NO: 61. In embodiments, the nucleic acid comprises one of the nucleic acid sequence of SEQ ID NO: 62-69. In embodiments, the first CAR and the second CAR are expressed as separate polypeptides.

In embodiments, the first antigen binding domain is on a CAR and the second antigen binding domain is on a T Cell Receptor (TCR). In embodiments, the TCR is a modified TCR. In embodiments, the TCR is derived from spontaneously occurring tumor-specific T cells in patients. In embodiments, the TCR binds a tumor antigen. In embodiments, the tumor antigen comprises CEA, gp100, tMUC1, MART-1, p53, MAGE-A3, or NY-ESO-1.

As used herein, "a thyroid antigen" refers to an antigen expressed on or by a thyroid cell. Examples of thyroid cells include follicular cells and parafollicular cells. A human TSHR is a receptor for thyroid-stimulating hormone (TSH) which is present on the thyroid membrane (SEQ ID NO: 20). When TSH secreted from the pituitary gland binds to TSHR on the thyroid follicle cell membrane, the thyroid gland secretes T3 and T4 having metabolic functions. TSHR is a seven-transmembrane receptor having a molecular weight of about 95,000 to 100,000 Daltons. It was reported that the human thyrotropin receptor (TSHR) includes three domains: a leucine-rich domain (LRD; amino acids 36-281), a cleavage domain (CD; amino acids 282-409), and a transmembrane domain (TMD; amino acids 410-699). Human thyrotropin (hTSH) a chains were found to bind many amino acids on the LRD surface and CD surface. As used herein, "TSHR" refers to human thyroid stimulating hormone receptor. The term should be construed to include not only human thyroid stimulating hormone receptor, but variants, homologs, fragments and portions thereof to the extent that such variants, homologs, fragments and portions thereof retain the ability of human thyroid stimulating hormone receptor to bind to antibodies or ligands of human thyroid stimulating hormone receptor as disclosed herein.

In certain embodiments, the antigen is a stomach or colon antigen. For example, the colon antigen is Guanylate cyclase 2C (GUCY2C) having SEQ ID NO: 23. As used herein, "a colon antigen" refers to an antigen expressed on or by a colon cell. Examples of colon cells include goblet cells and enterocytes. Guanylyl cyclase 2C (GUCY2C) is principally expressed in intestinal epithelial cells. GUCY2C is the receptor for diarrheagenic bacterial enterotoxins (STs) and the gut paracrine hormones, guanylin, and uroguanylin. These ligands regulate water and electrolyte transport in the intestinal and renal epithelia and are ultimately responsible for acute secretory diarrhea. As used herein, "GUCY2C" refers to human Guanylyl cyclase 2C. The term should be construed to include not only human Guanylyl cyclase 2C, but also variants, homologs, fragments and portions thereof to the extent that such variants, homologs, fragments and portions thereof retain the ability of Guanylyl cyclase 2C to bind antibodies or ligands of human Guanylyl cyclase 2C as disclosed herein. In embodiments, the amino acid sequence of at least a portion of GUCY2C comprises SEQ ID NO: 23. Claudin18.2 (CLDN 18.2) is a stomach-specific isoform of Claudin-18 and is highly expressed in gastric and pancreatic adenocarcinoma.

In embodiments, a T cell clone that expresses a TCR with high affinity for the target antigen may be isolated. Tumor-infiltrating lymphocytes (TILs) or peripheral blood mononuclear cells (PBMCs) can be cultured in the presence of antigen-presenting cells (APCs) pulsed with a peptide representing an epitope known to elicit a dominant T cell response when presented in the context of a defined HLA allele. High-affinity clones may then be selected on the basis of MHC-peptide tetramer staining and/or the ability to recognize and lyse target cells pulsed with low titrated concentrations of cognate peptide antigen. After the clone has been selected, the TCRα and TCRβ chains or TCRY and TCRo chains are identified and isolated by molecular cloning. For example, for TCRα and TCRβ chains, the TCRα and TCRβ gene sequences are then used to generate an expression construct that ideally promotes stable, high-level expression of both TCR chains in human T cells. The transduction vehicle, for example, a gammaretrovirus or lentivirus, can then be generated and tested for functionality (antigen specificity and functional avidity) and used to produce a clinical lot of the vector. An aliquot of the final product can then be used to transduce the target T cell population (generally purified from patient PBMCs), which is expanded before infusion into the patient.

Various methods may be implemented to obtain genes encoding tumor-reactive TCR. More information is provided in Kershaw et al., Clin Transl Immunology. 2014 May; 3 (5): e16. In embodiments, specific TCR can be derived from spontaneously occurring tumor-specific T cells in patients. Antigens included in this category include the melanocyte differentiation antigens MART-1 and gp100, as well as the MAGE antigens and NY-ESO-1, with expression in a broader range of cancers. TCRs specific for viral-associated malignancies can also be isolated, as long as viral proteins are expressed by transformed cells. Malignancies in this category include liver and cervical cancer, associated with hepatitis and papilloma viruses, and Epstein-Barr virus-associated malignancies. In embodiments, target antigens of the TCR may include CEA (e.g., for colorectal cancer), gp100, MART-1, p53 (e.g., for Melanoma), MAGE-A3 (e.g., Melanoma, esophageal and synovial sarcoma), NY-ESO-1 (e.g., for Melanoma and sarcoma as well as Multiple myelomas).

In embodiments, a binding domain of the first CAR binds CD19, and a binding domain of the second CAR binds tumor associated MUC1 (tMUC1). In embodiments, the binding domain of the second CAR comprises: (i) a heavy chain complementary determining region 1 comprising the amino acid sequence of SEQ ID: 76 or 85, a heavy chain complementary determining region 2 comprising the amino acid sequence of SEQ ID: 77 or 86, and a heavy chain complementary determining region 3 comprising the amino acid sequence of SEQ ID: 78 or 87; and (ii) a light chain complementary determining region 1 comprising the amino acid sequence of SEQ ID: 73 or 82, a light chain complementary determining region 2 comprising the amino acid sequence of TRP-ALA-SER (WAS) or SEQ ID: 83, and a light chain complementary determining region 3 comprising the amino acid sequence of SEQ ID: 75 or 84.

In embodiments, the binding domain of the second CAR comprises: (i) a heavy chain complementary determining region 1 comprising the amino acid sequence of SEQ ID: 76, a heavy chain complementary determining region 2 comprising the amino acid sequence of SEQ ID: 77, and a heavy chain complementary determining region 3 comprising the amino acid sequence of SEQ ID: 78; and (ii) a light chain complementary determining region 1 comprising the amino acid sequence of SEQ ID: 73, a light chain complementary determining region 2 comprising the amino acid sequence of TRP-ALA-SER (WAS), and a light chain complementary determining region 3 comprising the amino acid sequence of SEQ ID: 75.

In embodiments, the binding domain of the second CAR comprises: (i) a heavy chain complementary determining region 1 comprising the amino acid sequence of SEQ ID: 85, a heavy chain complementary determining region 2 comprising the amino acid sequence of SEQ ID: 86, and a heavy chain complementary determining region 3 comprising the amino acid sequence of SEQ ID: 87; and (ii) a light chain complementary determining region 1 comprising the amino acid sequence of SEQ ID: 82, a light chain complementary determining region 2 comprising the amino acid sequence of SEQ ID: 83, and a light chain complementary determining region 3 comprising the amino acid sequence of SEQ ID: 84. In embodiments, the binding domain of the first CAR comprises the amino acid sequence of SEQ ID: 5 or 6. In embodiments, the binding domain of the second CAR comprises one of the amino acid sequences of SEQ ID: 70-72 and 79-81.

In embodiments, the first CAR comprises the first antigen binding domain, a transmembrane domain, a co-stimulatory domain, and a CD3 zeta domain and/or the second CAR comprises the second antigen binding domain, a transmembrane domain, a co-stimulatory domain, and a CD3 zeta domain.

In embodiments, the first CAR and the second CAR are expressed as separate polypeptides.

In embodiments, the cytoplasmic domain or the transmembrane domain of the second CAR is modified such that the second CAR is capable of activating the modified T cell via cells expressing CD19 without damaging the cells expressing CD19.

Embodiments described herein relate to a bispecific chimeric antigen receptor, comprising: a first antigen binding domain, a second antigen binding domain, a cytoplasmic domain, and transmembrane domain, wherein the first antigen binding domain recognizes a first antigen, and the second antigen binding domain recognizes a second antigen, the first antigen is different from the second antigen.

In embodiments, the first antigen and the second antigen do not express on the same cell. In embodiments, the first antigen is an antigen of a blood component, and the second antigen is an antigen of a solid tumor.

Blood cells refer to red blood cells (RBCs), white blood cells (WBCs), platelets, or other blood cells. For example, RBCs are blood cells of delivering oxygen (O2) to the body tissues via the blood flow through the circulatory system. Platelets are cells that are involved in hemostasis, leading to the formation of blood clots. WBCs are cells of the immune system involved in defending the body against both infectious disease and foreign materials. There are a number of different types and sub-types of WBCs and each has a different role to play. For example, granulocytes, monocytes, and lymphocytes are 3 major types of white blood cell. There are three different forms of granulocytes: Neutrophils, Eosinophils, Basophils.

A cell surface molecule of a WBC refers to a molecule expressed on the surface of the WBC. For example, the cell surface molecule of a lymphocyte may include CD19, CD22, CD20, BCMA, CD5, CD7, CD2, CD16, CD56, and CD30. The cell surface molecule of a B cell may include CD19, CD20, CD22, BCMA. The cell surface molecule of a monocyte may include CD14, CD68, CD11b, CD18, CD169, and CD1c. The cell surface molecule of granulocyte may include CD33, CD38, CD138, and CD13.

In embodiments, the first antigen is CD19, and the second antigen is a tumor associated MUC1 (tMUC1). In embodiments, the first antigen binding domain comprises one of the amino acid sequences of SEQ ID: 5 and 6. In embodiments, the second antigen binding domain comprises one of the amino acid sequences of SEQ ID: 70-72 and 79-81.

In embodiments, the present disclosure describes a method of enhancing T cell response in a subject in need thereof or treating a tumor of a subject, the method comprising: administering an effective amount of a mixed population of modified T cells or a composition of a mixed population of modified T cells, described herein, to the subject to provide a T cell response such that the CAR T cell is expanded in the blood of the subject via cells expressing CD19. In embodiments, the method may further comprise infusing B cells into the subject to continue to activate and/or expand the CAR T cells. For example, the B cells of the subject or genetically modified B cells from healthy donor may be obtained and stored before CAR T cell infusion. In embodiments, the method may further comprise administering a cell expressing CD19 or a polypeptide comprising at least an extracellular domain of CD19 or the antigen that the CAR T cells recognize. For example, the cell expressing CD19 may include cell lines such as K562 and NK92 that are transduced with nucleic acid sequences encoding CD19. In embodiments, the method may further comprise identifying CAR T cells expressing both first and second CAR, as well as administering the identifier CAR T cells to the subject. For example, MUC1 may be associated as a sorting marker such that CAR T cells expressing MUC1 may be identified timely.

In embodiments, the tumor associated MUC1 (tMUC1) is expressed on tumor cells, but not on corresponding non-malignant cells. In embodiments, a scFv against the tumor associated MUC1 directly interacts with an o-glycosylated GSTA motif (SEQ ID NO. 88).

In embodiments, the present disclosure describes a method of in vivo cell expansion and maintenance. In embodiments, the method may include administering an effective amount of a mixed population of modified T cells described herein to the subject in need thereof to provide a T cell response; and administering an effective amount of presenting cells (e.g., T cells) expressing a soluble agent that an extracellular domain of the CAR recognizes. In embodiments, the method may be implemented to enhance T cell response in a subject in need thereof. The method may include administering an effective amount of a mixed population of modified T cells comprising a CAR to the subject to provide a T cell response and administering an effective amount of presenting cells expressing a soluble agent that an extracellular domain of the CAR recognizes to enhance the T cell response in the subject. In certain embodiments, the presenting cells are T cells, dendritic cells, and/or antigen presenting cells. In certain embodiments, the enhancing T cell response in the subject may include selectively enhancing proliferation of T cell comprising the CAR. In embodiments, the method may be used to enhance treatment of a condition of a subject using modified T cells. The method may include administering a population of cells that express an agent or administering an agent that is formulated as a vaccine. In these instances, the modified T cells include a nucleic acid that encodes a CAR, and an extracellular domain of the CAR recognize the agent. In embodiments, the method may be implemented to enhance proliferation of the modified T cells in a subject having a disease. The method may include preparing the modified T cells comprising a CAR; administering an effective amount of the modified T cells to the subject; introducing, into cells, a nucleic acid encoding an agent that an extracellular domain of the CAR recognizes; and administering an effective amount of the cells (introduced with the nucleic acid encoding the agent) to the subject. In embodiments, the T cell expansion may be measured based on an increase in copy number of CAR molecules in genomic DNA of the T cells. In embodiments, the T cell expansion may be measured based on flow cytometry analysis on molecules expressed on the T cells.

Embodiments described herein relate to mixed population of modified T cells comprising a first CAR and a second CAR or TCR in separate T cells and/or in the same T cells, wherein an antigen binding domain of the first CAR binds an antigen such as CD19, CD33, CD14, and BCMA, and an antigen binding domain of the second CAR binds a tumor associated MUC. In embodiments, the tumor associated MUC is MUC1 (for example tMUC1) or MUC2. Embodiments described herein relate to a composition comprising a mixed population of the modified T cells and to a method of enhancing T cell response in a subject in need thereof or treating a tumor of a subject, the method comprising: administering an effective amount of the mixed population of modified T cells.

In embodiments, the first CAR comprises the amino acid sequence of SEQ ID NO: 207, and the second CAR comprises the amino acid sequence of SEQ ID: 202. In embodiments, the first CAR comprises the amino acid sequence of SEQ ID NO: 203, 207, 216, or 219, and the second CAR comprises the amino acid sequence of SEQ ID: 202 or 205. In embodiments, the antigen binding domain of the second CAR comprises the amino acid sequence of SEQ ID NO: 70. In embodiments, the antigen binding domain of the second CAR comprises the amino acid sequence of SEQ ID NO: 5 or 6. In embodiments, the a modified T cell described herein comprises a nucleic acid sequences of SEQ ID NO: 201, 204, 206, 208, 215, 217, 218, or 220. In embodiments, each of the first CAR and the second CAR comprises an antigen binding domain, a transmembrane domain, and a cytoplasmic domain.

In embodiments, the cytoplasmic domain of the CAR molecules described herein comprise a co-stimulatory domain and a CD3 zeta domain. In embodiments, the CAR molecules described herein may include a co-stimulatory domain without a corresponding component of CD3 zeta domain. In embodiments, the CAR molecules described herein may include a CD3 zeta domain without a co-stimulatory domain.

In embodiments, the modified cell comprises a dominant negative variant of a receptor of programmed death 1 (PD-1), cytotoxic T lymphocyte antigen-4 (CTLA-4), B- and T-lymphocyte attenuator (BTLA), T cell immunoglobulin mucin-3 (TIM-3), lymphocyte-activation protein 3 (LAG-3), T cell immunoreceptor with Ig and ITIM domains (TIGIT), leukocyte-associated immunoglobulin-like receptor 1 (LAIRI), natural killer cell receptor 2B4 (2B4), or CD 160. In embodiments, the modified cell further comprises a nucleic acid sequence encoding a suicide gene, and/or the suicide gene comprises a HSV-TK suicide gene system. In embodiments, the isolated T cell comprises a reduced amount of TCR, as compared to the corresponding wide-type T cell.

Dominant negative mutations have an altered gene product that acts antagonistically to the wild-type allele. These mutations usually result in an altered molecular function (often inactive) and are characterized by a dominant or semi-dominant phenotype. In embodiments, the modified cells described herein comprise the dominant negative (DN) form of the PD-1 receptor. In embodiments, the expression of the DN PD-1 receptor in the modified cells described herein is regulated by an inducible gene expression system. In embodiments, the inducible gene expression system is a lac system, a tetracycline system, or a galactose system.

The present disclosure describes pharmaceutical compositions. The pharmaceutical compositions include one or more of the following: CAR molecules, TCR molecules, modified CAR T cells, modified cells comprising CAR or TCR, mix population of modified cells, nucleic acids, and vectors described herein. Pharmaceutical compositions are administered in a manner appropriate to the disease to be treated (or prevented). The quantity and frequency of administration will be determined by such factors as the condition of the patient, and the type and severity of the patient's disease, although appropriate dosages may be determined by clinical trials.

The term "pharmaceutically acceptable" means approved by a regulatory agency of the U.S. Federal or a state government or the EMA (European Medicines Agency) or listed in the U.S. Pharmacopeia Pharmacopeia (United States Pharmacopeia-33/National Formulary-28 Reissue, published by the United States Pharmacopeia Convention, Inc., Rockville Md., publication date: April 2010) or other generally recognized pharmacopeia for use in animals, and more particularly in humans.

The term "carrier" refers to a diluent, adjuvant {e.g., Freund's adjuvant (complete and incomplete)), excipient, or vehicle with which the therapeutic is administered. Pharmaceutical carriers can be sterile liquids, such as water and oils, including those of petroleum, animal, vegetable or synthetic origin, such as peanut oil, soybean oil, mineral oil, sesame oil and the like. Water is a preferred carrier when the pharmaceutical composition is administered intravenously. Saline solutions and aqueous dextrose and glycerol solutions can also be employed as liquid carriers, particularly for injectable solutions.

The present disclosure also describes a pharmaceutical composition comprising the first and the second population of cells, described herein. The pharmaceutical composition described herein, comprising a first population of cells comprising a first antigen binding molecule and a second population of cells comprising a second antigen binding domain, are suitable for cancer therapy. For example, the binding of first antigen binding molecule with an antigen enhances expansion of the cells suitable for cancer therapy.

The present disclosure also describes a method for enhancing cancer therapy using the cells described herein that are suitable for cancer therapy. The method comprises administering an effective amount of a first composition to the subject having a form of cancer expressing a tumor antigen, the first composition comprising a first population of cells (e.g., T cells) comprising a first antigen binding molecule (e.g., CAR) binding a first antigen; and administering an effective amount of a second composition to the subject, the second composition comprising a population of the cells comprising a second antigen binding molecule. Administration of the first and second compositions can be performed simultaneously or separately, for example sequentially. More information about the cells suitable for cancer therapy can be found at Eyileten et al., Immune Cells in Cancer Therapy and Drug Delivery, Mediators Inflamm. 2016; 2016:5230219, which is incorporated herein for reference.

In embodiments, the method comprises administering an effective amount of a population of CAR T cells binding a WBC antigen; and administering an effective amount of a population of CAR T cells binding a solid tumor antigen. In embodiments, the method comprises administering an effective amount of a population of CAR T cells binding a WBC antigen; and administering an effective amount of a population of T cells binding a solid tumor antigen (T cells used in TCR and TIL therapies). In embodiments, the method comprises administering an effective amount of a population of CAR T cells binding a WBC antigen; and administering an effective amount of a population of NK cells or NK cells expressing CAR binding a solid tumor antigen. In embodiments, the method comprises administering an effective amount of a population of CAR T cells binding a WBC antigen; and administering an effective amount of a population of NK cells or NK cells expressing CAR binding a solid tumor antigen. In embodiments, the method comprises administering an effective amount of a population of CAR T cells binding a WBC antigen; and administering an effective amount of a population of DCs or DCs expressing CAR binding a solid tumor antigen. In embodiments, the method comprises administering an effective amount of a population of CAR T cells binding a WBC antigen; and administering an effective amount of a population of macrophages or macrophages expressing CAR binding a solid tumor antigen. In embodiments, the method comprises administering an effective amount of a population of CAR T cells binding a WBC antigen; and administering an effective amount of a population of neutrophils or neutrophils expressing CAR binding a solid tumor antigen. In embodiments, the method comprises administering an effective amount of a population of CAR T cells binding a WBC antigen; and administering an effective amount of a population of lymphocytes binding or targeting a solid tumor antigen. In embodiments, the solid tumor antigen can be located on the cell surface (e.g., TSHR), on the extracellular matrix of tumor microenvironment (e.g., αvB5 integrin), and/or inside of tumor cells (e.g., gp100).

When "an immunologically effective amount", "an anti-tumor effective amount", "a tumor-inhibiting effective amount", or "a therapeutically effective amount" is indicated, the precise amount of the compositions of the present disclosure to be administered can be determined by a physician with consideration of individual differences in age, weight, tumor size, extent of infection or metastasis, and condition of the patient (subject). It can be stated that a pharmaceutical composition comprising the modified cells described herein may be administered at a dosage of $10^4$ to $10^9$ cells/kg body weight, preferably $10^5$ to $10^6$ cells/kg body weight, including all integer values within those ranges. Modified cell compositions may also be administered multiple times at these dosages. The cells can be administered by using infusion techniques that are commonly known in immunotherapy (see, e.g., Rosenberg et al., New Eng. J. of Med. 319:1676, 1988). The optimal dosage and treatment regime for a particular patient can readily be determined by one skilled in the art of medicine by monitoring the patient for signs of disease and adjusting the treatment accordingly. In certain embodiments, it may be desired to administer activated T cells to a subject and then subsequently redraw the blood (or have apheresis performed), collect the activated and expanded T cells, and reinfuse the patient with these activated and expanded T cells. This process can be carried out multiple times every few weeks. In certain embodiments, T cells can be activated from blood draws of from 10 cc to 400 cc. In certain embodiments, T cells are activated from blood draws of 20 cc, 30 cc, 40 cc, 50 cc, 60 cc, 70 cc, 80 cc, 90 cc, or 100 cc. Not to be bound by theory, using this multiple blood draw/multiple reinfusion protocols, may select out certain populations of T cells.

In embodiments, a mixed population of therapeutically effective amount of modified cells can be administered to the subject in need thereof sequentially or simultaneously. As an example, for a mixed population of two different modified cells, a therapeutically effective amount of the modified cells containing the antigen binding domain for expanding and/or maintaining the modified cells can be administered before, after, or at the same time a therapeutically effective amount of the modified cells containing the antigen binding domain for killing a target cell. As another example of a mixed population of two different modified cells, a therapeutically effective amount of the modified cells containing the antigen binding domain for killing a target cell can be administered before, after, or at the same time a therapeutically effective amount of the modified cells containing both the antigen binding domains of expanding and/or maintaining the modified cells and of killing a target cell (in a single modified cell). As an example, for a mixed population of three different modified cells including (1) modified cells containing an antigen binding domain for expanding and/or maintaining the modified cells, (2) modified cells containing an antigen binding domain for killing a target cell, and (3) modified cells containing both the antigen binding domains of expanding and/or maintaining the modified cells and of killing a target cell (in a single modified cell), a therapeutically effective amount of (1), (2), and (3) can be administered sequentially in any order (1, 2, 3; 2, 3, 1; 3, 1, 2; 1, 3, 2; 2, 1, 3; or 3, 2, 1) or simultaneously (1+2+3 at the same time). Moreover, two of the three modified cells can be combined and administered together with the third one being administered before or after the combination. For example, the combination of (1) and (2) can be administered before or after (3); or the combination of (1) and (3) can be administered before or after (2); or the combination of (2) and (3) can be administered before or after (1).

The administration of the pharmaceutical compositions described herein may be carried out in any convenient manner, including by aerosol inhalation, injection, ingestion, transfusion, implantation, or transplantation. The compositions described herein may be administered to a patient subcutaneously, intradermally, intratumorally, intranodally, intramedullary, intramuscularly, by intravenous (i. v.) injection, or intraperitoneally. In embodiments, the modified cell compositions described herein are administered to subjects by intradermal or subcutaneous injection. In embodiments, the T cell compositions of the present disclosure are administered by i.v. injection. The compositions of modified cells may be injected directly into a tumor, lymph node, or site of infection. In embodiments, cells activated and expanded using the methods described herein, or other methods known in the art where T cells are expanded to therapeutic levels, are administered to patients in conjunction with (e.g., before, simultaneously or following) any number of relevant treatment modalities, for example as a combination therapy, including but not limited to treatment with agents for antiviral therapy, cidofovir and interleukin-2, Cytarabine (also known as ARA-C); or natalizumab treatment for MS patients; or efalizumab treatment for psoriasis patients or other treatments for PML patients. In further embodiments, the T cells described herein can be used in combination with chemotherapy, radiation, immunosuppressive agents, such as cyclosporin, azathioprine, methotrexate, mycophenolate, and FK506, antibodies, or other immunoablative agents such as CAM PATH, anti-CD3 antibodies or other antibody therapies, cytoxin, fludaribine, cyclosporin, FK506, rapamycin, mycophenolic acid, steroids, FR901228, cytokines, and irradiation. These drugs inhibit either the calcium dependent phosphatase calcineurin (cyclosporine and FK506) or inhibit the p70S6 kinase that is important for growth factor induced signaling (rapamycin). (Liu et al., Cell 66:807-815, 1991; Henderson et al., Immun 73:316-321, 1991; Bierer et al., Curr. Opin. Immun 5:763-773, 1993; Isoniemi (supra)). In embodiments, the cell compositions described herein are administered to a subject in conjunction with (e.g., before, simultaneously or following) bone marrow transplantation, T cell ablative therapy using either chemotherapy agents such as, fludarabine, external-beam radiation therapy (XRT), cyclophosphamide, or antibodies such as OKT3 or CAMPATH. In embodiments, the cell compositions described herein are administered following B-cell ablative therapy. For example, agents that react with CD20, e.g., Rituxan may be administered to patients. In embodiments, subjects may undergo standard treatment with high dose chemotherapy followed by peripheral blood stem cell transplantation. In certain embodiments, following the transplant, subjects receive an infusion of the expanded immune cells of the present disclosure. In embodiments, expanded cells are administered before or following surgery. The dosage of the above treatments to be administered to a subject in need thereof will vary with the precise nature of the condition being treated and the recipient of the treatment. The scaling of dosages for human administration can be performed according to art-accepted practices by a physician depending on various factors. Additional information on the methods of cancer treatment using modified cells is provided in U.S. Pat. No. 8,906,682, incorporated by reference in its entirety.

Embodiments described herein relate to an in vitro method for preparing modified cells. The method may include obtaining a sample of cells from a subject. For example, the sample may include T cells or T cell progenitors. The method may further include transfecting the sample of cells with a DNA encoding at least a CAR and culturing the sample of cells ex vivo in a medium that selectively enhances proliferation of CAR-expressing T cells. The sample of cells can be a mixed population of modified cells described herein.

In embodiments, the sample is a cryopreserved sample. In embodiments, the sample of cells is from umbilical cord blood or a peripheral blood sample from the subject. In embodiments, the sample of cells is obtained by apheresis or venipuncture. In embodiments, the sample of cells is a subpopulation of T cells.

Embodiments of the present disclosure relate to a Zinc Finger Nuclease (ZFN) comprising a DNA-binding domain comprising zinc finger DNA binding proteins and a DNA-cleaving domain comprising a cleavage domain and/or a cleavage half-domain. The zinc finger DNA binding proteins may include 1, 2, 3, 4, 5, 6 or more zinc fingers, each zinc finger having a recognition helix that binds a target subsite in the target gene. In embodiments, the zinc finger proteins comprise 3, 4, 5, 6 fingers (where the fingers are designated F1, F2, F3, F4, F5 and F6 and are ordered F1 to F3, F4 or F5 or F6 from the N-terminus to the C-terminus), and the fingers comprise the amino acid sequence of the recognition regions shown in Table 5. Examples of cleavage domains and/or cleavage half-domains include wild-type or engineered Fokl cleavage half-domain. In embodiments, the DNA cleaving domain comprises a wild-type cleavage domain or cleavage half-domain (e.g., a Fokl cleavage half-domain). In embodiments, the cleavage domain and/or cleavage half-domain comprise engineered (non-naturally occurring) cleavage domains or cleavage half-domains, for example, engineered Fokl cleavage half-domains that form obligate heterodimers. In embodiments, the gene is a human gene. In embodiments, the cleavage domain comprises a wild-type or engineered Fokl cleavage domain. Embodiments relate to a polynucleotide encoding the isolated ZFN as described herein. Embodiments relate to a vector comprising the polynucleotide. In embodiments, the vector is an adenoviral or lentiviral vector. Embodiments relate to an isolated cell or a cell line comprising the isolated ZFN described herein. In embodiments, the isolated cell is a stem cell, a T cell, or a Natural Killer (NK) cell. In embodiments, the cell is a T cell derived from a primary human T cell isolated from a human donor. In embodiments, the cell has reduced expression of an endogenous gene of CTLA4, LAG3, BTLA, TIM3, FOXP3, SIVA1, or LGALS9. In embodiments, various gene editing techniques or overexpression techniques (e.g., Cas9, TALEN, and ZFN) can be used to regulate T/NK cell functions by knocking out, knocking down, overexpressing, or inserting one or more genes. For example, the modified cell has reduced or increased expression of one or more genes of a biosynthesis or transportation pathway of a peptide in List 1 and List 2 (see Paragraph 268), as compared to the corresponding wild-type cell. In embodiments, the target gene is Runx3. For example, the modified T/NK cell has increased expression of Runx3 as compared to the corresponding wild-type cell. As an example, the increased expression of Runx3 helps the infiltration of T cells or their long-term residence within tumor cells, therefore increasing T cell killing effects. In embodiments, the modified cell is a modified stem cell, a modified T cell, or a modified Natural Killer (NK) cell. In embodiments, the modified cell is a T cell derived from a primary human T cell isolated from a human donor. In embodiments, the cell has a reduced expression of an endogenous gene of CTLA4, LAG3, BTLA, TIM3, FOXP3, SIVA1, and LGALS9.

CTLA4 is an inhibitory receptor acting as a major negative regulator of T-cell responses. T lymphocyte receptor CTLA-4 binds co-stimulatory molecules CD80 (B7-1) andCD86 (B7-2) with higher avidity than stimulatory co-receptor CD28 and negatively regulates T cell activation. LAG3 is a member of the immunoglobulin superfamily and is expressed on the surface of activated T and NK cells. LAG3 has also been detected on the surface of B cells, dendritic cells, TILs and Tregs. Blockage of LAG3 significantly increases T cell proliferation and function. TIM3 is an immune checkpoint receptor constitutively expressed by CD4+ T helper 1 (Th1), CD8+ T cytotoxic 1 cells (Tc1) and Th17 cells. The interaction between TIM3 and its ligand galectin-9 LGALS9 is believed to result in suppression of T-cell responses. FOXP3 is a member of the forkhead/winged-helix family of transcriptional regulators, which is crucial for the development and inhibitory function of regulatory T-cells (Treg). SIVA1 induces CD27-mediated apoptosis, inhibits BCL2L1 isoform Bcl-x(L) anti-apoptotic activity, inhibits activation of NF-kappa-B, and promotes T-cell receptor-mediated apoptosis.

Embodiments relate to modified cells comprising isolated nucleic acid sequence encoding a chimeric antigen receptor (CAR), wherein an endogenous gene is inactivated using the ZFN.

In embodiments, the CAR comprises an antigen binding domain, a transmembrane domain, a co-stimulatory domain, and a CD3 zeta signaling domain.

In embodiments, the modified T cell has a reduced graft-versus-host disease (GVHD) response in a bioincompatible human recipient as compared to the GVHD response of the primary human T cell.

In embodiments, the antigen binding domain of the CAR binds FZD10, TSHR, PRLR, Muc17, GUCY2C, CD207, CD19, or CD20.

In embodiments, the antigen binding domain of the CAR binds at least one of B7, BCMA, CAIX, CD123, CD133, CD138, CD171, CD171/L1-CAM, CD19, CD2, CD22, CD30, CD33, CEA, cMet, CS1, CSPG4, Dectin1, EGFR, EGFR vill, EphA2, ERBB receptors, ErbB T4, ERBB2, FAP, Folate receptor 1, FITC, Folate receptor 1, GD2, GPC3, HA-1 H/HLA-A2, HER2, IL-11Ra, IL13 receptor a2, IL13R, IL13Ra2 (zetakine), Kappa, LewisY, Mesothelin, MUC1, NKG2D, NY-ESO-1, PSMA, ROR-1, TRAIL-receptor1, or VEGFR2.

In embodiments, the co-stimulatory domain of the CAR comprises the intracellular domain of a co-stimulatory molecule selected from the group consisting of CD27, CD28, 4-1BB, OX40, CD30, CD40, PD-1, ICOS, lymphocyte function-associated antigen-1 (LFA-1), CD2, CD7, LIGHT, NKG2C, B7-H3, and any combination thereof.

In embodiments, the modified cells include a nucleic acid sequence encoding hTERT or a nucleic acid encoding SV40LT, or a combination thereof. In embodiments, the modified cells include a nucleic acid sequence encoding hTERT and a nucleic acid encoding SV40LT. In embodiments, the expression of hTERT is regulated by an inducible expression system. In embodiments, the expression of SV40LT gene is regulated by an inducible expression system.

In embodiments, the inducible expression system is rTTA-TRE, which increases or activates the expression of SV40LT gene or hTERT gene, or a combination thereof. In embodiments, the modified cells include a nucleic acid sequence encoding a suicide gene. In embodiments, the suicide gene includes an HSV-TK suicide gene system. In these instances, the modified cell can be induced to undergo apoptosis.

The present disclosure describes methods of treating cancer in a subject, the methods comprising administering a mixed population of modified cells described herein to the subject, wherein the cancer is selected from the group consisting of a lung carcinoma, pancreatic cancer, liver cancer, bone cancer, breast cancer, colorectal cancer, leukemia, ovarian cancer, lymphoma, and brain cancer.

The methods described herein include a modified T cell and/or modified NK cell comprising a reduced amount of one or more peptides including PD1, PDL1, PDL2, CTLA4, LRBA, LAG3, Tim3, BILA, CD160, 2B4, SOCS1, SOCS3, Foxp3, CCR4, PVRIG, CD16B, SIVA1, CD33, LAGLS9, CD122, IDO1, CD45, Cvp1b1, TNFAIP8L2, ID02, TD02, DNMT3A, and/or Ceacam-1 (List 1), as compared to a corresponding wild-type cell. In embodiments, the methods of treating cancer in a subject including enhancing the modified T cell and/or NK cell response of these T cells and/or NK cells (having a reduced amount of one or more peptides listed immediately above) when the mixed population of genetically modified T cells is administrated into a subject The methods include a modified T cell and/or modified NK cell comprising an increased amount of one or more peptides including Runx3, lexm, PILRA, Ptnns1L3, Fcgr3a, Nat8, Ccl9, Hck, Trem2, Ccl6, Cd36, Igf1, Ctss, Gzmc, Batf, Cxcl2, TNFAIP8L3, Il1b, TRPV1, TRPV2, TRPV3, TRPV4, Rgs1, PLSCR1, ITGB2, C3AR1, ITGA3, ITGA5, ITGAL, batf, batf3, Cxcl2, CARD11, and/or CD83 (List 2), as compared to a corresponding wild-type cell. In embodiments, the methods of treating cancer in a subject include enhancing the T cell and/or NK cell response of these T cells and/or NK cells (having an increased amount of the one or more peptides listed immediately above) when the modified T cells and/or modified NK cells are administrated to a subject. In embodiments, various gene editing techniques or overexpression techniques (e.g., Cas9, TALEN, and ZFN) may be used to regulate the functions of T cell and/or NK cell by knocking out/knocking down/overexpressing/inserting one or more genes encoding one or more peptides in list 1 or 2. For example, the genetically modified T cell has reduced or increased expression of one or more genes of a biosynthesis or transportation pathway of a peptide in list 1 and list 2 (see above), as compared to the corresponding wild-type cell.

In embodiments, the target gene is Runx3. For example, the modified T cells have increased expression of Runx3 as compared to the corresponding wild-type cell. In these instances, the increased expression of Runx3 may help, for example, the infiltration or long-term residence of the modified T cells within the tumor cells, therefore increasing T cell killing effects.

For example, T cell response in a subject refers to cell-mediated immunity associated with helper, killer, regulatory, and other types T cells. For example, T cell response may include activities such as assistance to other white blood cells in immunologic processes and identifying and destroying virus-infected cells and tumor cells. T cell response in the subject may be measured via various indicators such as a number of virus-infected cells and/or tumor cells that the T cells kill, an amount of cytokines that the T cells release in co-culturing with virus-infected cells and/or tumor cells, a level of proliferation of the T cells in the subject, a phenotype change of the T cells (e.g., changes to memory T cells), and the longevity or the length of the lifetime of the T cells in the subject.

T cell response also includes the release of cytokines. Although cytokine release is often associated with systemic inflammation and complication of disease, the release of cytokines appears to be also associated with the efficacy of a CAR T cell therapy. The release of cytokines may correlate with expansion and progressive immune activation of adoptively transferred cells, such as in CAR T cell therapy. The present disclosure describes the release of effector cytokines, such as IFN-γ, and pro- and anti-inflammatory cytokines, such as IL-6, in response to mixed population of modified T cells described herein, especially in response to the presence of a first CAR including an antigen binding domain for expanding cells and a second CAR or TCR including an antigen binding domain for killing a target cell. In embodiments, the present disclosure describes the release of IL-6 and IFN-γ in a subject introduced with the first CAR and second CAR or TCR described herein. In embodiments, the subject is in need of cancer treatment, and the cancer treatment is pancreatic cancer treatment. In embodiments, the present disclosure describes determining the efficacy or monitoring the efficacy of a CAR T cell therapy by measuring the level of cytokine release. In embodiments, the release of cytokines (e.g., IL-6 and/or IFN-γ) in the subject in response to CAR T cell therapy using mixed population of modified T cells described herein is more than that using T cells comprising the second CAR without the first CAR.

In embodiments, the modified cells described herein may further comprise a dominant negative variant of a receptor of programmed death 1 (PD-1), cytotoxic T lymphocyte antigen-4 (CTLA-4), B- and T-lymphocyte attenuator (BTLA), T cell immunoglobulin mucin-3 (TIM-3), lymphocyte-activation protein 3 (LAG-3), T cell immunoreceptor with Ig and ITIM domains (TIGIT), leukocyte-associated immunoglobulin-like receptor 1 (LAIRI), natural killer cell receptor 2B4 (2B4), or CD 160 such that the T cell response induced by the mixed population of modified cells may be enhanced. In embodiments, the modified cells described herein may further comprise a nucleic acid sequence encoding a suicide gene, and/or a suicide gene comprising an HSV-TK suicide gene system such that the fate of the modified cell may be controlled. For example, the T cell can be induced to undergo apoptosis if the therapy imposes risks to the subject, and/or the subject encounters adverse effects, or if the therapy has been completed, a certain required condition has been met, and/or a predetermined time has passed.

The present disclosure describes a composition comprising a mixed population of modified cells described herein. In embodiments, there is a first population of modified cells comprising a first CAR binding a first antigen, and a second population of modified cells comprising a second CAR or TCR binding a second antigen that is different from the first antigen. The first antigen can be an antigen of a WBC, such as a B cell, while the second antigen is a tumor antigen. The present disclosure describes a method of enhancing expansion and maintenance of the second population of modified cells for killing tumor cells. The method includes administering an effective amount of the composition comprising a mixed population of modified cells to a subject having a form of cancer associated with the tumor antigen which the second CAR recognizes and binds. Embodiments also include a method of enhancing T cell response in a subject in need thereof or treating a subject having cancer. The method includes administering an effective amount of the composition described herein to the subject having a form of cancer associated with the tumor antigen which the second CAR recognizes and binds. Further the embodiments include a method of enhancing expansion and/or maintenance of modified cells in a subject, the method comprising: contacting T cells with a first vector comprising a first nucleic acid sequence encoding the first CAR and a second vector comprising a second nucleic acid sequence encoding the second CAR to obtain the composition described herein of a mixed population of modified cells; and administering an effective amount of the composition to the subject having a form of cancer associated with the tumor antigen which the second CAR recognizes and binds. Additional embodiments include a method of enhancing T cell response in a subject in need thereof or treating a subject having cancer, the method comprising: contacting T cells with a first vector comprising a first nucleic acid sequence encoding the first CAR and a second vector comprising a second nucleic acid sequence encoding the second CAR to obtain the composition described herein of a mixed population of modified cells; and administering an effective amount of the composition to the subject having a form of cancer associated with the tumor antigen, which the second CAR recognizes and binds. Embodiments include a method of enhancing expansion and maintenance of the modified cells in a subject, the method comprising: administering an effective amount of the composition described herein of a mixed population of modified cells.

Figure 87A:
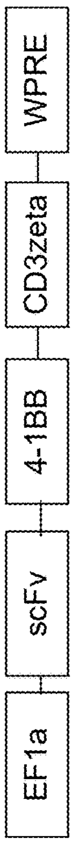
FIGS. 87A-87D illustrate exemplary constructs of polynucleotides encoding recombinant proteins and exemplary structure of antibodies.
Figure 87B:
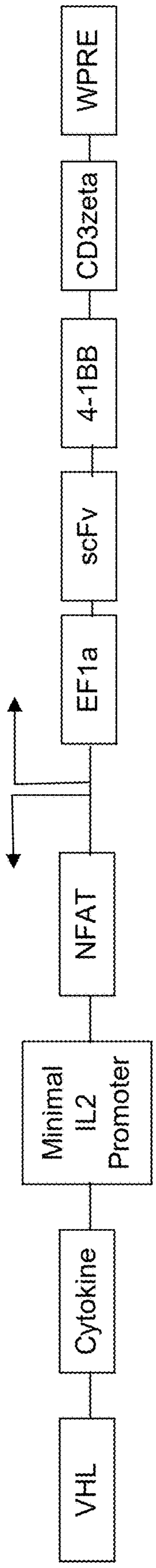

In embodiments, the composition comprises at least the first population and second population of modified cells. The first population of modified cells comprises a polynucleotide encoding the first CAR (e.g., CD19, CD22, and BCMA CARs) and a polynucleotide encoding one or more cytokines (e.g., IL-6, IL12, and IFNγ). The second population of modified cells comprises a polynucleotide encoding the second CAR binding a solid tumor antigen. For example, the composition comprises the first population, the second, the third, and the fourth populations of modified cells. The first population of modified cells comprises a polynucleotide encoding CAR binding a WBC antigen and IL-6 (e.g., FIG. 87B). The second population of modified cells comprises a polynucleotide encoding CAR binding a solid tumor antigen (e.g., FIG. 87A). The third population of modified cells comprises a polynucleotide encoding CAR binding a WBC antigen and IL-12 (e.g., FIG. 87B). The fourth population of modified cells comprises a polynucleotide encoding CAR binding a WBC antigen and IFNγ (e.g., FIG. 87B). These WBC antigens can be the same (e.g., CD19) or different (e.g., CD19 and BCMA). The first, the third, and the fourth populations of modified cells can be mixed based on a first predetermined ratio to obtain a group of modified cells, which can be then mixed based on a second predetermined ratio with the second population of modified cells to obtain a composition comprising a mixed population of modified cells. The predetermined ratio is used to control the amount of expression of the one or more cytokines in the subject to achieve controllable, lasting, and efficient cytokine effects in the subject while having less cytotoxicity. In embodiments, the first predetermined ratio ratio the first, the third, and the fourth populations of modified cells is set such that there are more of modified cells comprising the polynucleotide encoding IFNγ than the modified cells comprising the polynucleotide encoding IL-12 or IL-6. For example, the first predetermined ratio is 1:1:10. In embodiments, the second predetermined ratio is determined such that there are more of the modified cells comprising the polynucleotide encoding the second CAR (e.g., the second population of modified cells) than the modified cells comprising the polynucleotide encoding the first CAR (e.g., the first, the second, and/or the third populations of modified cells). For example, the second predetermined ratio of the first population of modified cells and the second population of modified cells is less than 1:1 but more than 1:10,000. In embodiments, the second predetermined ratio is 1:1, 1:10, 1:100, 1:1000, and 1:104, as well as individual numbers within that range, for example, 1:10, 1:100, or 1:1000. In embodiments, the second predetermined ratio is between 1:10 and 1:1000. In embodiments, the second predetermined ratio is between 1:10 and 1:100. In embodiments, the second predetermined ratio is between 1:1 and 1:100. In embodiments, the cells (e.g., NK cells, T cells, B cells, myeloid-derived cells, etc.) are obtained from a subject or a healthy donor and divided into at least two groups. These groups of cells may be transferred with two or more vectors, respectively. These cells can be further modified if obtained from a healthy donor. In embodiments, the second population of modified cells does not express the one or more cytokines.

In embodiments, a polynucleotide encoding the first CAR is present in the modified cell in a recombinant DNA construct, in an mRNA, or in a viral vector. In embodiments, the polynucleotide is an mRNA, which is not integrated into the genome of the modified cell, such that the modified cell expresses the first CAR (e.g., CD19 CAR) for a finite period of time.

In embodiments, the mixed population of modified cells further includes a third population of modified cells expressing a third CAR and/or a fourth population of modified cells expressing a fourth CAR such that immune responses caused by the various population of modified cells can be coupled to boost CAR T treatment. In embodiments, CARs may be replaced by TCRs or a combination of CAR and TCR.

Embodiments relate to a method of enhancing CAR T therapy by implementing multiple infusion of CAR T cells timely. The method includes obtaining PBMC from a subject or a healthy donor, preparing CAR T cells using the obtained PBMC, culturing the CAR T cells, for example, for a predetermined amount of time, administering a portion of the cultured CAR T cells to the subject, observing and/or measuring the CAR T cells in the blood of the subject, administering a second portion of the cultured CAR T cells when the level of the CAR T cells in the blood reaches a predetermined value or when the CAR T cells home to an organ (e.g., lymph node). For example, the first infused CAR T cells can be selectively activated and expanded in the organ and cause an immune response by the subject. Thus, infusion of the second portion of CAR T cells can be coupled with the immune response to enhance the activation and/or expansion of the second population of CAR T cells, thus enhancing the CAR T therapy.

The present disclosure describes a composition including a population of modified cells including a first population of modified cells that comprises a first CAR without a second CAR, and/or a second population of modified cells that comprises a second CAR without a first CAR. The present disclosure also describes a composition including a population of modified cells comprising the first CAR and second CAR (in a single modified cell). In embodiments, the composition includes a first and a second population of modified cells and a third population of modified cells comprising one or more nucleic acid sequences encoding the first CAR and the second CAR in the same modified cell. In embodiments, the composition comprises a second population of modified cells, in the absence of a first population of genetically modified cells, and a third population of modified cells comprising one or more nucleic acid sequences encoding the first CAR and the second CAR in the same modified cells.

Embodiments relate to a method of using or the use of polynucleotide encoding the antigen binding molecule and/or therapeutic agent(s) to enhance the expansion of the modified cells or to enhance the T cell response in a subject. The method or use includes: providing a viral particle (e.g., AAV, lentivirus or their variants) comprising a vector genome, the vector genome comprising the polynucleotide, wherein the polynucleotide is operably linked to an expression control element conferring transcription of the polynucleotide; and administering an amount of the viral particle to the subject such that the polynucleotide is expressed in the subject. In embodiments, the AAV preparation may include AAV vector particles, empty capsids and host cell impurities, thereby providing an AAV product substantially free of AAV empty capsids. More information of the administration and preparation of the viral particle may be found at the U.S. Pat. No. 9,840,719 and Milani et al., Sci. Transl. Med. 11, eaav7325 (2019) 22 May 2019, which are incorporated herein by reference.

In embodiments, the polynucleotide may integrate into the genome of the modified cell and the progeny of the modified cell will also express the polynucleotide, resulting in a stably transfected modified cell. In embodiments, the modified cell expresses the polynucleotide encoding the CAR but the polynucleotide does not integrate into the genome of the modified cell such that the modified cell expresses the transiently transfected polynucleotide for a finite period of time (e.g., several days), after which the polynucleotide is lost through cell division or other factors. For example, the polynucleotide is present in the modified cell in a recombinant DNA construct, in an mRNA, or in a viral vector, and/or the polynucleotide is an mRNA, which is not integrated into the genome of the modified cell.

In embodiments, the first population of cells comprises the first CAR and the second CAR, and the second population of cells comprises the first CAR but does not comprise the second CAR. In embodiments, the first population of cells comprises the first CAR and the second CAR, and the second population of cells comprises the first CAR and the second CAR. In embodiments, first population of cells comprises the first CAR but does not comprise the second CAR, the second population of cells comprises the first CAR and the second CAR. In embodiments, the first population of cells comprises the first CAR but does not contain the second CAR, and the second population of cells comprise the second CAR but does comprise first CAR. In embodiments, first population of cells comprises the second CAR but does not comprise the first CAR and the second population of cells comprises the first CAR and the second CAR. In embodiments, the first population of cells comprises the first CAR but does not comprise the second CAR; the second population comprises a second CAR but does not comprise the first CAR; and a third population comprises the first CAR and the second CAR. As described herein, the first CAR includes an antigen binding domain for expanding and/or maintaining the modified cells, and the second CAR includes an antigen binding domain for killing target cells, such as tumors.

In embodiments, the antigen binding domain binds an antigen that is or that comprises a cell surface molecule of a white blood cell (WBC), a tumor antigen, or a solid tumor antigen. In embodiments, the WBCs are T cells, NK cells, or dendritic cells.

In embodiments, the WBC is a granulocyte, a monocyte, or lymphocyte. In embodiments, the WBC is a B cell. In embodiments, the cell surface molecule or antigen of the B cell is CD19, CD22, CD20, BCMA, CD5, CD7, CD2, CD16, CD56, CD30, CD14, CD68, CD11b, CD18, CD169, CD1c, CD33, CD38, CD138, or CD13. In embodiments, the cell surface molecule or antigen of the B cell is CD19, CD20, CD22, or BCMA. In embodiments, the cell surface molecule or antigen of the B cell is CD19.

In embodiments, the tumor antigen is a solid tumor antigen. In embodiments, the solid tumor antigen is tMUC1, PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Ra2, Mesothelin, PSMA, ROR1, VEGFR-II, GD2, FR-α, ErbB2, EpCAM, EGFRvIII, B7-H3, or EGFR.

In embodiments, the solid tumor antigen is or comprises tumor associated MUC1 (tMUC1), TSHR, GUCY2C, ACPP, CLDN18.2 (18.2), PSMA, or UPK2.

In embodiments, the CAR comprises the antigen binding domain, a transmembrane domain, a co-stimulatory domain, and a CD3 zeta domain. In embodiments, the co-stimulatory domain comprises the intracellular domain of CD27, CD28, 4-1BB, OX40, CD30, CD40, PD-1, ICOS, lymphocyte function-associated antigen-1 (LFA-1), CD2, CD7, LIGHT, NKG2C, B7-H3, a ligand that specifically binds with CD83, or a combination thereof. In embodiments, the second CAR includes a binding domain that binds tMUC1 and a co-stimulatory domain that includes an intracellular domain of CD28; and/or the first CAR includes a binding domain that binds CD19 and a co-stimulatory domain that includes an intracellular domain of 4-1BB.

In embodiments, the first population of cells and/or the second population of cells further comprise a dominant negative form of a checkpoint protein or of the checkpoint protein's receptor present on T cells (e.g., PD-1). In embodiments, the first population of cells comprise a vector comprising a nucleic acid encoding the first CAR and the dominant negative form of PD-1.

In embodiments, the second CAR comprises a scFv binding tMUC1, an intracellular domain of 4-1BB or CD28, CD3 zeta domain, and the second CAR comprises a scFv binding CD19, an intracellular domain of 4-1BB or CD28, CD3 zeta domain. In embodiments, the first CAR comprises a scFv, which is SEQ ID NO: 5, and the second CAR comprise a scFv, which is the SEQ ID NO: 70. Corresponding sequences are listed in Table 5.

Embodiments relate to a method comprising administering an effective amount of the second population of T cells comprising a second CAR comprising a scFv binding tMUC1 to a patient having cancer. The second CAR may further comprise an intracellular domain of 4-1BB or CD28, CD3 zeta domain. In embodiments, the method further comprises administering an effective amount of the first population of T cells comprising a first CAR comprising a scFv binding CD19 to the patient, thereby enhancing expansion of the second population of T cells in the patient. The CAR may further comprise an intracellular domain of 4-1BB or CD28, and CD3 zeta domain.

In embodiments, the second CAR comprises the intracellular domain of CD28, and the first CAR comprises the intracellular domain of 4-1BB. In this instance, the first population of T cells comprising CD19 may cause less adverse effect on the patient (e.g., CRS), and/or the second population of T cells comprising tMUC1 may cause enhanced T cell response (e.g., killing) as compared to those of the second CAR comprising the intracellular domain of 4-1BB and/or the first CAR comprising the intracellular domain of CD28. In embodiments, the second CAR comprises the intracellular domain of CD28 such that the second population of T cells may cause enhanced T cell response (e.g., killing) as compared to that of the second CAR comprising the intracellular domain of 4-1BB. In embodiments, the first CAR comprises the intracellular domain of 4-1BB such that the first population of T cells may cause less adverse effect on the patient (e.g., CRS) as compared to that of the first CAR comprising the intracellular domain of CD28.

In embodiments, the second population of cells comprises the scFv binding a solid tumor antigen but do not comprise the scFv binding a B cell antigen, and the first population of cells comprises the scFV binding an antigen different from the solid tumor antigen (e.g., a WBC antigen or a B cell antigen) but do not comprise the scFV binding the tumor antigen. In these instances, the T cell response of the patient induced by binding between the first population of T cells and the antigen (e.g., CD19) may cause both the first and second populations of T cells to expand. Accordingly, the patient may be administered with a mixed population of genetically engineered T cells consisting essentially of the first population of cells and the second population of cells. In embodiments, the patient may be administered with the second population of genetically engineered T cells and one or more recombinant proteins (e.g., cytokine such as IL6 and/or INFγ) or cells expressing and secretion of the one or more recombinant proteins, which may induce similar or enhanced T cell response caused by the first population of T cells. In embodiments, the patient may be administered with the second population of T cells and a hormone drug (e.g., fulvestrant), which may induce similar or enhanced T cell response caused by the first population of T cells.

In embodiments, the first population of modified cells can further comprise a third CAR comprising the scFv binding tMUC1, the intracellular domain of 4-1BB or CD28, and the CD3 zeta domain. In embodiments, the second population of cells does not comprise the scFv binding CD19. In embodiments, the first population of cells does not comprise the scFv binding tMUC1.

In embodiments, the methods described herein of enhancing cell expansion and/or cell response in a subject are compared to methods in which the subject is administered with only one CAR (for example, only the first CAR or only the second CAR) and/or the subject is not administered with a mixed population of cells described herein. In embodiments, the mixed population of cells described herein enhances the expansion of the cells and/or the cell response.

Embodiments relate to a composition and a method for treating a subject having cancer or enhancing T cell response of the subject. The method includes administering to the subject an effective amount of a population of modified cells having a first CAR. The first CAR includes an antigen binding domain, a transmembrane domain, a co-stimulatory domain of CD28, and/or a CD3 zeta domain. The method can further include monitoring and/or measuring one or more parameters of T cell response induced by the modified cells. For example, the one or more parameters include cytokine release, lymphocyte numbers, and a level of CAR T cell expansion and exhaustion. The method can further include administering an effective amount of a population of modified cells including a second CAR to the subject in response to a predetermined time (e.g., one or two weeks after the infusion) and/or condition, which may be associated with the measured parameters (e.g., a copy number of CAR and numbers of CAR T cells). The second CAR includes an antigen binding domain, a transmembrane domain, a co-stimulatory domain of 4-1BB, and/or a CD3 zeta domain. It has been reported that CD28 CAR T cells and 4-1BB CAR T cells behave differently in the lab and in the clinic. Accordingly, the method combines the advantages of the two co-stimulatory domains by coupling the strong initial immune response with the long and persistent immune response. For example, the first CAR including CD28 elicits a robust T cell activation and is associated with effector-like differentiation. While the first CAR can cause T cell exhaustion, it is designed to induce a strong initial response of the subject's immune system. The second CAR including the 4-1BB reduces T cell exhaustion, enhance persistence, and increases central memory differentiation and mitochondrial biogenesis, which are designed for persistent CAR T therapy. In embodiments, the initial response induced by the first CAR can enhance the persistent CAR T therapy. In embodiments, the population of modified cells including the first CAR and the population of modified cells including the second CAR may be administered to the subject at the same time. For example, the composition may include the population of modified cells including the first CAR and the population of modified cells including the second CAR. In embodiments, the first CAR binds an antigen of WBC, and the second CAR binds a solid tumor antigen. In embodiments, the first CAR and the second CAR bind the same or different solid tumor antigens. For example, a population of modified cells including a CAR that binds a solid tumor antigen (e.g., TSHR) and includes 4-1BB co-stimulatory domain and a population of modified cells including a CAR that binds the solid tumor antigen (e.g., TSHR) or another solid tumor antigen (e.g., tMuc1) and includes CD28 co-stimulatory domain were mixed together to obtained a mixed modified cells. In embodiments, the modified cells may be further administered to the subject. In embodiments, the modified cells may be further administered to the subject along with a population of modified cells including a CAR binding a WBC antigen (e.g., CD19).

In embodiments, the CAR molecules described herein comprise one or more complementarity-determining regions (CDRs) for binding an antigen of interest. CDRs are part of the variable domains in immunoglobulins and T cell receptors for binding a specific antigen. There are three CDRs for each variable domain. Since there is a variable heavy domain and a variable light domain, there are six CDRs for binding an antigen. Further since an antibody has two heavy chains and two light chains, an antibody has twelve CDRs altogether for binding antigens. In embodiments, the CAR molecules described herein comprise one or more CDRs for binding antigens. In embodiments, the one or more CDRs bind the antigen of a WBC, such as a B cell. As an example, the one or more CDRs bind CD19, the cell surface antigen of a B cell. In embodiments, the one or more CDRs bind a tumor antigen, for example, tMUC1. TSHR, GUCY2C, ACPP, CLDN18.2 (18.2), PSMA, or UPK2.

Figure 61:
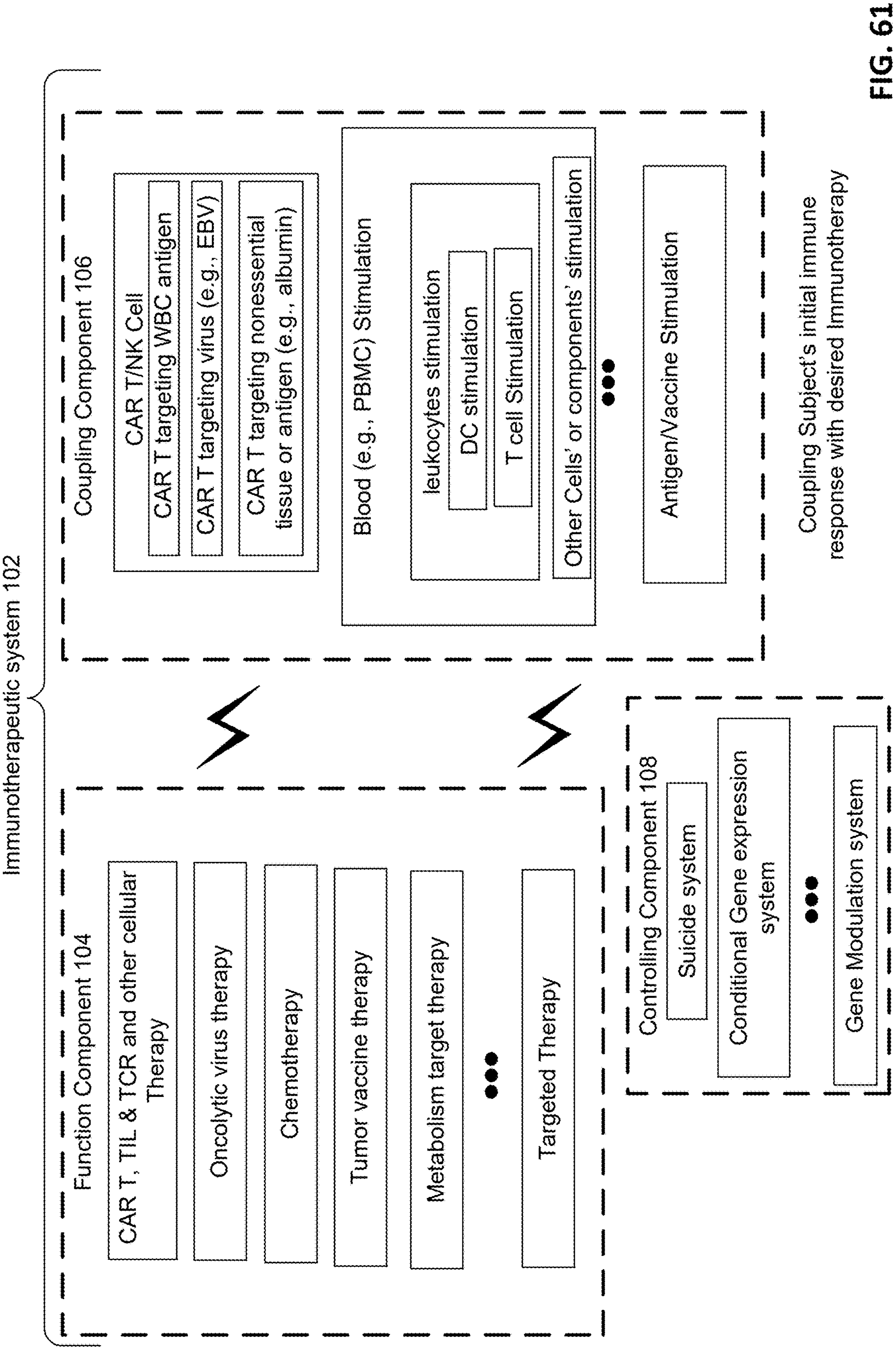
FIG. 61 shows a schematic overview of an immunotherapeutic system.

Embodiments relate to an immunotherapeutic system and its use for treating cancer of a subject. As shown in FIG. 61, the immunotherapeutic system 102 includes function component 104 configured to inhibit growth of tumor cells, coupling component 106 configured to couple the subject's immune response with the inhibition of the growth of tumor cells, and controlling component 108 configured to control the inhibition and/or coupling. In embodiments, the immunotherapeutic system 102 is a composition comprising one or more pharmaceutical compositions (e.g. antibodies and cells) suitable for treating cancer.

Figure 77A:
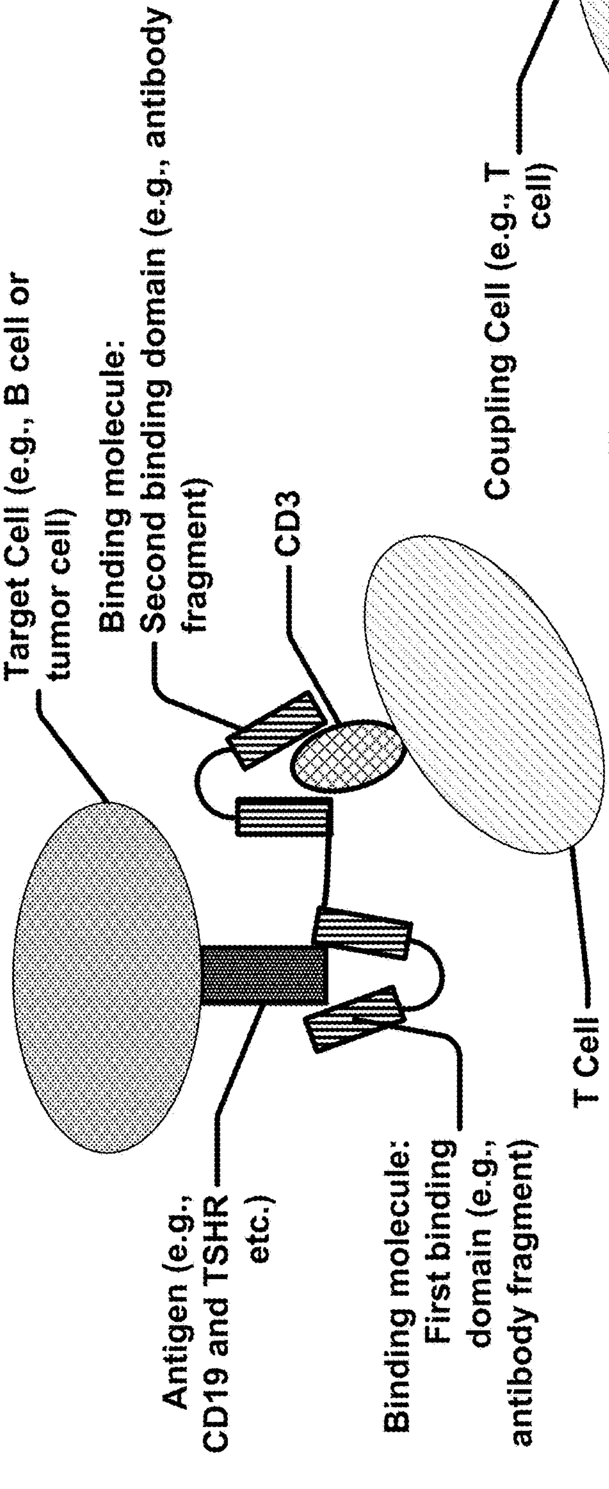
FIGS. 77A and B illustrate exemplary structures of binding molecules.

Examples of function component 104 include CAR T, TIL, and TCR and other cellular therapies, an oncolytic virus therapy, a chemotherapy, a tumor vaccine therapy, a metabolism target therapy, and targeted therapy. In embodiments, function component 104 includes at least one of the inhibitors that regulate immune metabolism (e.g., IDO inhibitors and adenosine inhibitors); the immunomodulators (e.g., IMiDs); the agonists against monocytes or dendritic cells (e.g., TLRs/STING); an oncolytic virus therapy; the tumor vaccines (e.g., DC vaccines); the tumor infiltrating T cells (e.g., Tils); the macrophage-reprogramming agents (e.g., CCR2-CCL2 inhibitor, CSF-1Rs inhibitor, PPAR-gamma agonist/inhibitor and CD-40 agonist); the chemotherapy drugs (e.g., cyclophosphamide, fludarabine and ibrutinib); the monoclonal antibody targeting drugs (e.g., anti-her2); or the targeted drugs for non-monoclonal antibodies (e.g., ALK inhibitors, EGF/VEGF inhibitors). Example targets of TCR therapy are listed in Table 6. In embodiments, function component 104 can be implemented by a Bite molecule (e.g., TSHR-CD3). In embodiment, a Bite molecule comprises a first and a second binding domain, wherein the first binding domain binds to a solid tumor antigen, and the second binding domain binds, for example, the T cell CD3 receptor complex or CD28, as illustrated in FIG. 77A. The second binding domain can also bind other T cell molecules such as 4-1BB, OX40, GTTR, ICOS, NKG20, etc.

Examples of coupling component 106 include immune response elicited by CAR T/NK cells, DC stimulation, T cell stimulation, and antigen/vaccine stimulation. The CAR T/NK cells include the modified cells described in the present disclosure. For example, the modified cell includes a CAR binding an antigen of WBC (e.g., CD19), an antigen of EBV, and/or albumin. T cell stimulation may be implemented by a Bite molecule (e.g., CD19-CD3). DC cell stimulation may be implemented by administering CAR T/NK cells to the subject, or administering a small molecule, small peptide, vaccine, or antigen to lymphoid organs (e.g., lymph node) of the subject. In embodiment, a Bite molecule may comprise a first and a second binding domain, wherein the first binding domain binds to an antigen, and the second binding domain binds, for example, the T cell CD3 receptor complex or CD28, as illustrated in FIG. 77A. The second binding domain can bind other T cell molecules such as 4-1BB, OX40, GITR, ICOS, NKG20, etc. The antigen may bind a WBC antigen (e.g., CD19 and BCMA). In embodiments, CAR T cells may express the Bite molecule. In embodiments, CAR T cells and the Bite molecule may be administered to the subject at same time or separately.

Figure 87C:
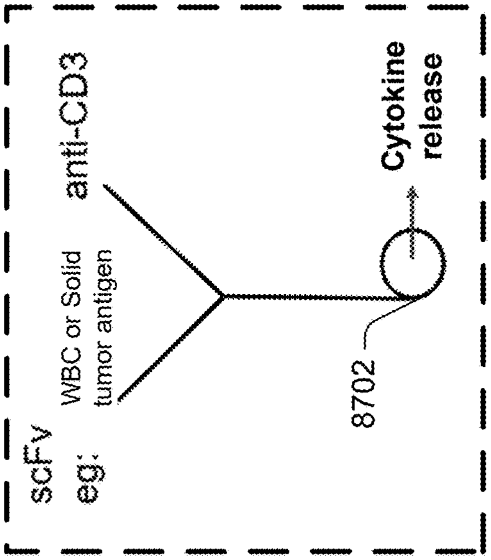
Figure 87D:
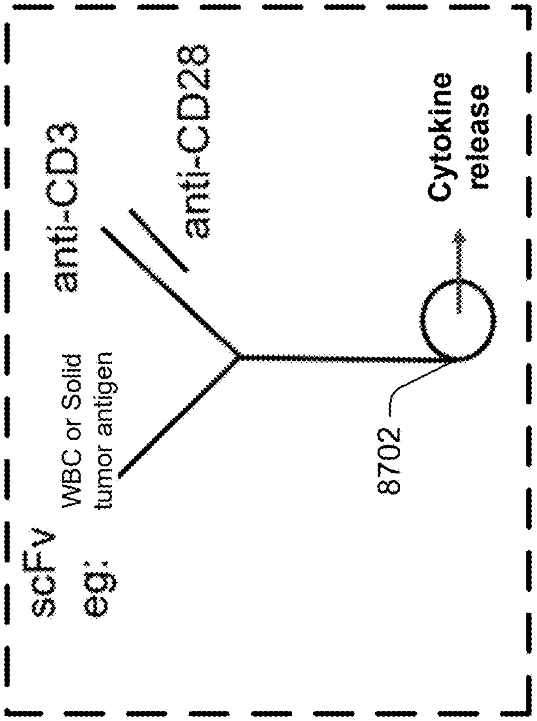

In embodiments, the immunotherapeutic system 102 can comprise various Bite antibodies to treat cancer. In embodiments, the immunotherapeutic system 102 comprises a first Bite molecule and a second Bite molecule. The first Bite molecule can comprise a first and a second binding domain, wherein the first binding domain binds to a solid tumor antigen, and the second binding domain binds, for example, the T cell CD3 receptor complex or CD28. The second Bite molecule can comprise a third and a fourth binding domain, wherein the third binding domain binds to an antigen, and the fourth binding domain binds, for example, the T cell CD3 receptor complex or CD28. In embodiments, the immunotherapeutic system 102 comprises modified bispecific antibodies or trispecific antibody (e.g., FIGS. 87C and 87D) as well as the first Bite and/or the second Bite antibodies. In these instances, antibody techniques can be used to stimulate cells to secrete one or more cytokines (e.g., IL-6, IL-12, IL-15, IL-7, and IFNγ) in or close to tumor microenvironment. Component 8702 can be implemented to function as a stimulator that stimulate various cells to enhance cytokine releases. For example, the stimulator can comprise agonists or ligands directly or indirectly cause a subject to secrete one or more cytokines (e.g., IL-6, IL-12, IL-7, IL-15, and IFNγ). In embodiments, uses of the first and/or the second Bite molecules can be combined with the administration of human recombinant forms of the one or more cytokines. In embodiments, the therapeutic agent can be isolated, synthetic, native, or recombinant human cytokines. In embodiments, administering an effective amount of the human recombinant cytokine comprises intravenous delivery of an amount of IL-6 in the range of about 0.5-50 μg per kilogram of body weight. In embodiments, the human recombinant cytokine comprises IL-6 or IL-7. Recombinant IL-15 can be administered as a daily bolus infusion for a predetermined time or days at 3 mcg/kg/day and 1 mcg/kg/day. Recombinant IFNγ can be administered at a dose of 2 million units daily for 5 days per week over a predetermined time. In embodiments, administering the effective amount of the human recombinant cytokine comprises administering an effective amount of the human recombinant cytokine such that concentrations of the cytokines, such as IL-6 and/or IFN-γ, in the blood of the subject can increase 5-1000 times (e.g., 50 times). Methods of administering IL-6, IL-15, and/or IFNγ can be found in U.S. Pat. No. 5,178,856A and Cytokines in the Treatment of Cancer, Volume 00, Number 00, 2018 of Journal of Interferon & Cytokine Research, which are incorporated herein by reference in their entirety. In embodiments, recombinant IL-12 can be administered at 30 ng/kg as a starting dose and escalated to 500 ng/kg twice weekly after the infusion of CAR T cells. Methods of administering of IL-12 can be found in Leuk Res. 2009 November; 33 (11): 1485-1489, which is incorporated here by reference. In embodiments, the human recombinant cytokine can be administered to the subject starting from day 0, 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 days after administration.

Figure 77B:
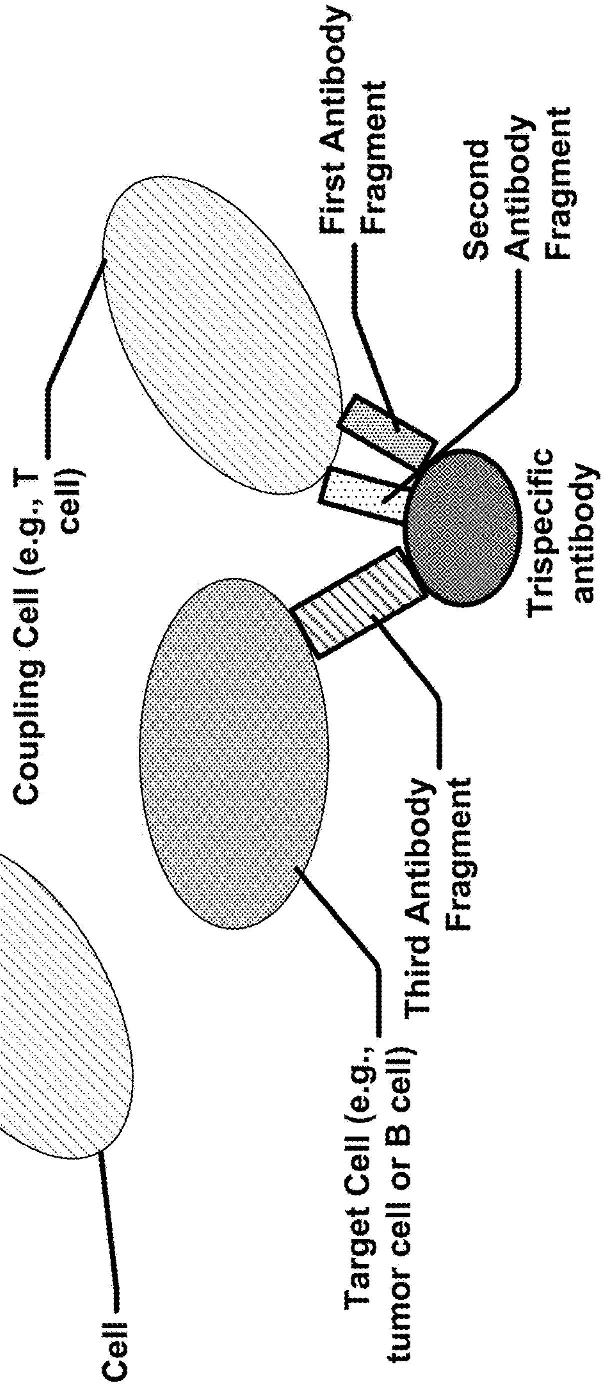

In embodiments, the coupling component 106 and the function component 104 may combined and implemented using lentiviral vectors encoding the CAR binding a solid tumor antigen and a superantigen that result in excessive activation of the immune system of the subject. For example, the population of modified cells comprise a lentiviral vector encoding the CAR and a superantigen, the superantigen is Aravan virus Nucleoprotein, Australian bat lyssavirus Nucleoprotein, Duvenhage virus Nucleoprotein, European bat lyssavirus 1 Nucleoprotein, Irkut virus Nucleoprotein, Khujand virus Nucleoprotein, Maize mosaic virus Nucleoprotein, Mokola virus Nucleoprotein, Mouse mammary tumor virus Protein PR73, Rabies virus Nucleoprotein, Rice yellow stunt virus Nucleoprotein, *Staphylococcus aureus* Enterotoxin, Taro vein chlorosis virus Nucleoprotein or West Caucasian bat virus Nucleoprotein. The nucleoproteins may be modified with addition of an extracellular signal peptide. In embodiments, CAR T cells may be combined with bispecific or trispecific antibodies to treat tumors. The CAR T cells may bind a solid tumor antigen. In embodiments, CAR T cells and the antibodies may be administered to the subject at same time or separately. In embodiments, CAR T cells may express the antibodies. The bispecific antibody may comprise a first antibody fragment targeting CD3, CD28, 41-BB, GITR, OX40, etc. and a second antibody fragment targeting a solid tumor antigen or a WBC antigen. The trispecific antibody may comprise a first antibody fragment targeting, for example, CD3, TLR, FcR or NKG2D, a second antibody fragment targeting, for example, CD28, 41-BB, GITR, or OX40, and a third antibody fragment targeting, for example, a WBC antigen or a solid tumor antigen, as illustrated in FIG. 77B.

The present disclosure also describes a population of modified cells comprising a polynucleotide encoding a CAR and the bispecific antibody or the trispecific antibody described above. The present disclosure also describes a population of modified cell expressing a CAR and the bispecific antibody or the trispecific antibody described above.

Figure 65:
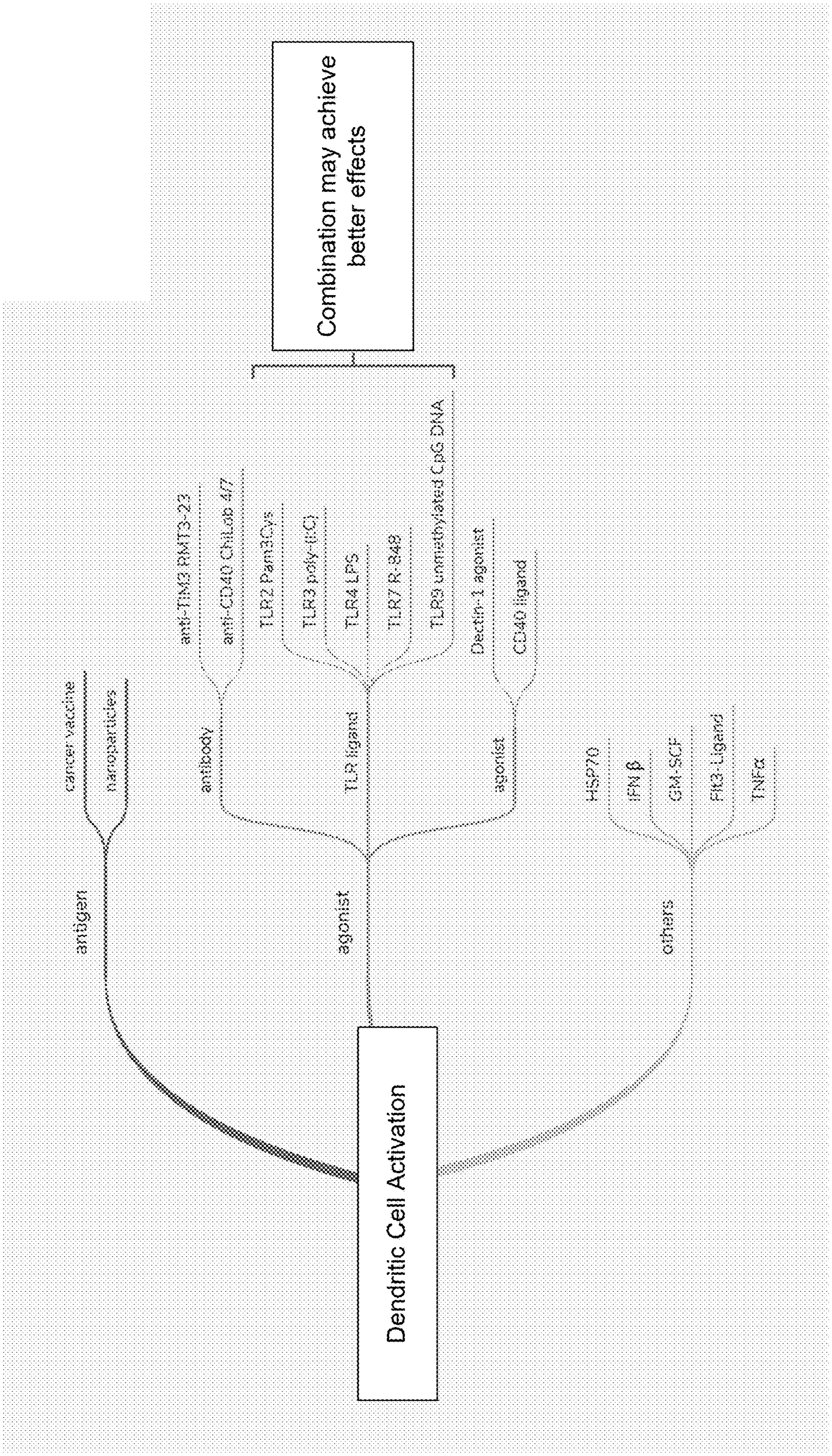
FIG. 65 is a schematic diagram of exemplary implementations of dendritic cell activation.

As shown in FIG. 65, there are three ways to activate dendritic cells (DCs). The first way is to deliver the antigen (e.g., CEA, PSA or TERT) to the DCs. For example, cancer vaccine or Nanoparticles comprising the antigen can activate DCs which in turn can activate the immune system. The second way is by delivering an agonist (e.g., cytokines) to accelerate the DCs' maturation and release related cytokines directly or indirectly. The third way is to deliver cytokines or proteins that helps the activation of DCs. Other methods can also be implemented to activate DCs. For example, DC may be stimulated by various methods such as LPS, various viruses, *Plasmodium* antigen, cytokines, and vaccine. In embodiments, a small molecule (e.g., CpG oligonucleotides and imiquimod, prototypic drugs) can be associated with an albumin to be delivered to a lymph node to stimulate DCs, which can then selectively cause expansion of CAR T cells homing to the lymph node. The Examples of the present disclosure show that some T cells (e.g., central memory T cells) do not stably remain in the blood after infusions but enter lymphoid organs such as lymph nodes due to molecules such as CCR7 and CD62L on the T cells. Thus, direct and/or indirect stimulation of DCs can selectively expand and/or activate CAR T cells showing more memory-like phenotypes, thus, enhancing efficacy of T therapy. More information about the implementation can be found in Ma et al., Science 365, 162-168 (2019), which is incorporated by reference.

Antigen/vaccine stimulation may be implemented by the following embodiments. As an example, the method comprises: administering an effective amount of T cells (e.g., TILs, CAR T, TCR cells) to a subject in need thereof to treat tumor (e.g., solid tumor), and administering an effective amount of an agent that directly or indirectly activates the T cells. In embodiments, the agent includes an antigen that the T cells recognize. In embodiments, the agent includes presenting cells expressing a soluble agent that the extracellular domain of the CAR recognizes. In embodiments, the agent includes vaccines derived from the antigen. For example, the agent includes the antigen associated with albumin such that the agent activates the T cells in, for example, the lymph nodes and then activate DCs, eliciting expansion of the T cells.

Examples of controlling component 108 include a suicide system (e.g., suicide gene), conditional gene expression system (e.g., lac, tetracycline, or galactose systems), and gene modulation system (e.g., Hif1a, NFAT, FOXP3, and/or NFkB).

Figure 62:
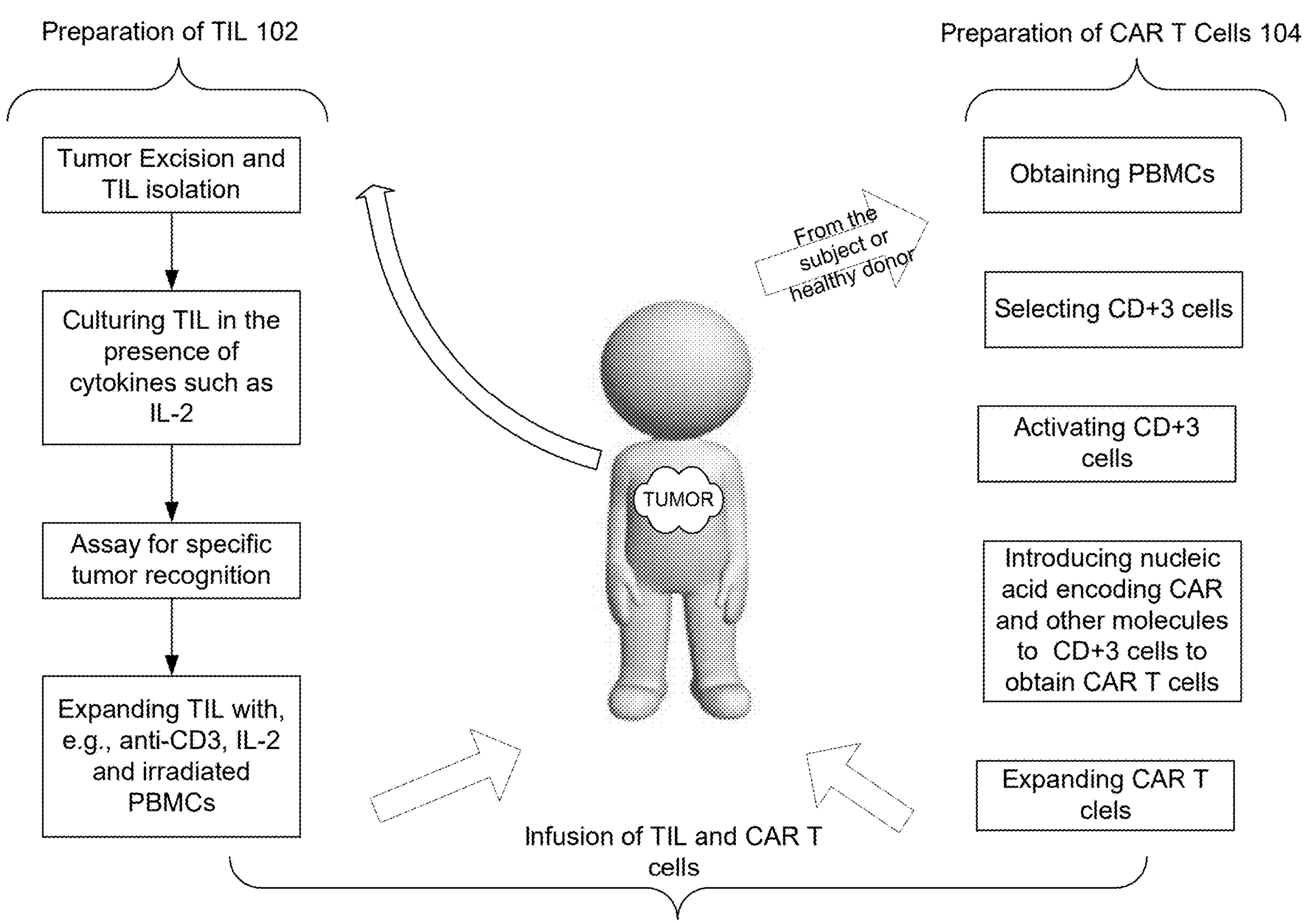
FIG. 62 shows a schematic overview of an implementation of the immunotherapeutic system in FIG. 61.

FIG. 62 shows an immunotherapeutic system, for example immunotherapeutic system 102. In embodiments, the population of modified cells comprises two types of cells: function component cells and coupling component cells. The function component cells are capable of inhibiting tumor cells. In embodiments, the function components cells include a binding molecule binding a tumor antigen (e.g., a solid tumor antigen). For example, the binding molecule is or includes a CAR or a TCR that binds a solid tumor. In embodiments, the coupling component cells include a CAR targeting a white blood cell antigen. In embodiments, the coupling component cells include modified cells including a nucleic acid sequence encoding IL12 linked to a HIF VHL binding domain, and/or modified cells including a nucleic acid sequence encoding IL6 and IFNγ linked by a 2A peptide.

FIG. 62 shows a schematic overview of an example process for the combination of CAR T cells and tumor-infiltrating lymphocytes (TIL). PBMCs of a subject can be obtained and CAR T targeting an antigen of WBC (e.g., CD19) can be prepared using various methods described in the present disclosure. In embodiments, the CAR T cells can be Coupling Component cells described in FIG. 61. The subject can then be lymphodepleted. TILs can be prepared using various methods. An example of the methods is the preparation of TIL 102. For example, after excision, the tumor metastasis is digested into a single cell suspension in 24 well plates. These suspensions/fragments are then cultured in the presence of IL-2. In embodiments, the cultures are tested for recognition of autologous melanoma cells (for example, melanoma cell lines or freshly frozen tumor digest, and if not available a panel of HLA-matched allogeneic tumor cell lines), by measuring IFNγ secreted in the medium using an IFNγELISA. In embodiments, the selection step for tumor reactivity can be omitted. TIL cultures are then expanded to treatment levels by stimulation with soluble anti-CD3 monoclonal antibody and high concentration of IL-2, and irradiated allogeneic feeder cells. After the TIL cultures are purified to obtain the product cells, the product cells are ready to be infused with CAR T cells that enhance TIL expansion in the subject. Information on TILs preparations may be found in International Application NOs: WO2018/081473 and WO201S/094167 and Molecular Oncology, Volume 9, Issue 10, December 2015, Pages 1918-1935, which are incorporated herein by reference. There are three theoretical problems that need to be resolved for T cells to overcome solid tumors. The first problem is the identification of the T cells that recognize the tumor. Instead of identifying only one target, it is necessary to identify as many heterogeneous cancer cells as possible. In this regard, TIL (Tumor Infiltrating T Lymphocyte) Therapy seems promising. The second challenge is to allow these screened T cells that recognize tumors to overcome the suppression of the tumor microenvironment. The third challenge is to allow these screened population of T cells that recognize tumors and overcome the microenvironmental inhibition and expand sufficiently to fight advanced tumors and reverse the course of the disease. Ordinary TIL technology is amplified in large quantities in vitro, but at a high cost and long cycles. Excessive costs can lead to high drug prices in the future, and too long a cycle can make advanced cancer patients unable to afford, which will challenge future applications of the product to treatment. Accordingly, Immunotherapeutic system 102 can be helpful for the latter two challenges. Coupling component 106 can couple a subject's immune response with TIL therapy, for example, to expand TILs in the subject, reducing the cost and shortening the cycle associated with the TIL therapy and/or overcoming the suppression of the tumor microenvironment by maintaining the population of TILs in the subject.

The present disclosure describes a composition for treating blood cancer (e.g., leukemia, melanoma, and lymphoma). Example of blood cancers include Chronic lymphocytic leukemia (CLL) and Non-Hodgkin lymphoma (NHL). The composition comprises mixed population of modified cells comprising at least two groups of modified cells, each having a polynucleotide encoding a CAR binding a blood cancer antigen (e.g., CD19, CD20, and BCMA). One group of the mixed population of modified cells further comprises a polynucleotide encoding one or more recombinant proteins (e.g., IL-6, IL-12, IL-7, IL-15, and IFNγ). For example, the mixed population of modified cells comprises a first group of modified cells comprising a polynucleotide encoding CD19 CAR (e.g., FIG. 87A) and at least one of a second group of modified cells comprising a polynucleotide encoding CD19 CAR and IL-6, a third group of modified cells comprising a polynucleotide encoding CD19 CAR and IL-12, and a fourth group of modified cells comprising a polynucleotide encoding CD19 CAR and IFNγ (e.g., FIG. 87B). These groups of modified cells can be mixed to obtain the mixed population of modified cells, which are administered to a subject having B cell leukemia and lymphoma. In embodiments, the mixed population of modified cells can be mixed based on a predetermined ratio to obtain the mixed population of modified cells. The predetermined ratio is used to control the amount of expression of the one or more cytokines in the subject to achieve controllable, lasting, and efficient cytokine effects in the subject while experiencing less cytotoxic effects. In embodiments, the predetermined ratio for the first, the second, the third, and the fourth groups of modified cells is set such that there are more of the first group of modified cells than the second, third, or fourth group of modified cells in the mixed population of modified cells. For example, the predetermined ratio of the first group of modified cells and the second, the third, or the fourth group of modified cells is 10:1. In embodiments, the predetermined ratio is 1:1, 10:1, 100:1, 1000:1, and 104:1, as well as individual numbers within that range, for example, 10:1, 100:1, or 1000:1. In embodiments, the second predetermined ratio is between 10:1 and 1000:1. In embodiments, the second predetermined ratio is between 10:1 and 1:100. In embodiments, the second predetermined ratio is between 1:1 and 100:1.

The present disclosure describes a composition for treating solid tumor. The composition comprises two populations of modified cells. The first population of modified cells comprises two or more groups of modified cells. One group of modified cells comprises a polynucleotide encoding the first CAR (e.g., CD19, CD22, BCMA CARs) and at least one other group of modified cells comprises a polynucleotide encoding one or more cytokines (e.g., IL-6, IL12, and IFN) or encoding the one or more cytokines and the first CAR. In embodiments, the first CAR binds a WBC antigen. For example, the first population of modified cells comprises a first group of modified cells comprising a polynucleotide encoding CD19 CAR (e.g., FIG. 87A) and a second group of modified cells comprising a polynucleotide encoding CD19 CAR and a cytokine (e.g., Embodiment 2 of FIG. 87). The first and second groups of modified cells are mixed to obtain the first population of modified cells. In embodiments, the first and second groups of modified cells are mixed based on a third predetermined ratio such that there are more of the first group of modified cells than the second group of modified cells in the first population of modified cells. For example, the third predetermined ratio of the first group of cells to the second group of modified cells is 10:1. In embodiments, the second population of modified cells comprises a CAR binding a solid tumor antigen. In embodiments, the second population of modified cell does not express the one or more cytokines. The first population and the second population of modified cells can be mixed to obtain the mixed population of modified cells, which are infused in the subject. In embodiments, the first population and the second population of modified cells can be mixed based on a fourth predetermined ratio such that there are more of the second population of modified cells than the first population of modified cells. For example, the second predetermined ratio of the first population and the second population of modified cells is less than 1:1 but more than 1:10,000. In embodiments, the fourth predetermined ratio is 1:1, 1:10, 1:100, 1:1000, and 1:104, as well as individual numbers within that range, preferably 1:10, 1:100, or 1:1000. In embodiments, the fourth predetermined ratio is between 1:10 and 1:1000. In embodiments, the second predetermined ratio is between 1:10 and 1:100. In embodiments, the second predetermined ratio is between 1:1 and 1:100. The predetermined ratio is used to control the amount of expression of the one or more cytokines in the subject to achieve controllable, lasting, and efficient cytokine effects in the subject while having less cytotoxicity.

The present disclosure is further described by reference to the following exemplary embodiments and examples. These exemplary embodiments and examples are provided for purposes of illustration only and are not intended to be limiting unless otherwise specified. Thus, the present disclosure should in no way be construed as being limited to the following exemplary embodiments and examples, but rather, should be construed to encompass any and all variations which become evident as a result of the teaching provided herein.

EXEMPLARY EMBODIMENTS

The following are exemplary embodiments:

1. A population of modified cells effective for expanding and/or maintaining the modified cells in a patient, wherein the population of modified cells comprise at least two different modified cells: a first modified cell comprising an antigen binding domain for expanding and/or maintaining the modified cells; and a second modified cell comprising an antigen binding domain for killing a target cell, such as a tumor cell. In embodiments, the modified cells are modified T cells. In embodiments, the at least two different modified cells include two different modified T cells, two different modified immune cells, or a combination thereof. In embodiments, the modified immune cells include modified T cells, DC cells, and/or macrophages.

2. The population of modified cells of embodiment 1, wherein the antigen binding domains bind different antigens.

3. The population of modified cells of embodiment 1, wherein the population of modified cells further comprises a third modified cell expressing at least two different antigen binding domains, a first antigen binding domain for expanding and/or maintaining the modified cells and a second antigen binding domain for killing a target cell, and wherein the two different antigen binding domains are expressed on the same cell.

4. The population of modified cells of embodiment 1, wherein the population of modified cells comprises a modified cell expressing an antigen binding domain for killing a target cell and a modified cell expressing at least two antigen binding domains, a first antigen binding domain for expanding and/or maintaining the modified cells and a second antigen binding domain for killing a target cell, and wherein the two different antigen binding domains are expressed on the same modified cell.

5. The population of modified cells of embodiment 1, wherein the population of modified cells includes a modified cell expressing an antigen binding domain for expanding and/or maintaining the modified cells and a modified cell expressing at least two antigen binding domains, a first antigen binding domain for expanding and/or maintaining the modified cells and a second antigen binding domain for killing a target cell, and wherein the two different antigen binding domains are expressed on the same modified cell.

6. The population of modified cells of any one of embodiments 1-5, wherein the modified cell is a modified T cell, a modified NK cell, a modified macrophage, or a modified dendritic cell. 7. The population of modified cells of any one of embodiments 1-6, wherein the antigen binding domain for expanding/or and maintaining the modified cells bind the surface antigen of a WBC, and the antigen binding domain for killing a target cell binds a tumor antigen.

8. The population of modified cells of embodiment 7, wherein the WBC is a B cell.

9. The population of modified cells of embodiment 7, wherein the cell surface antigen of the WBC is CD19, CD22, CD20, BCMA, CD5, CD7, CD2, CD16, CD56, CD30, CD14, CD68, CD11b, CD18, CD169, CD1c, CD33, CD38, CD138, or CD13.

10. The population of modified cells of any one of embodiments 1-9, wherein the solid tumor antigen is tMUC1, PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Ra2, Mesothelin, PSMA, ROR1, VEGFR-II, GD2, FR-α, ErbB2, EpCAM, EGFRvIII, B7-H3, EGFR, or one of those listed in Table 1.

11. The population of modified cells of embodiment 7, wherein the cell surface antigen of the WBC is CD19, CD20, CD22, or BCMA.

12. The population of modified cells of embodiment 7, wherein the cell surface antigen of a B cell is CD19, and the tumor antigen is tMUC1, TSHR, GUCY2C, ACPP, CLDN18.2 (18.2), PSMA, or UPK2.

13. A composition comprising a first population of cells comprising a first CAR binding a first antigen and a second population of cells comprising a second CAR binding a second antigen, wherein the second antigen is a tumor antigen and the first antigen and second antigen are different antigens.

14. The composition of embodiment 13, wherein the first population of cells does not comprise the second CAR, and/or the second population of cells does not comprise the first CAR.

15. The composition of embodiment 14, wherein the composition further comprises a third population of cells comprising the first CAR and the second CAR.

16. The composition of embodiment 13, wherein the second population of cells further comprises the first CAR, and the first population of cells do not comprise the second CAR; or the first population of cells further comprises the second CAR.

17. The composition of embodiment 13, wherein second population of cells does not comprise the first CAR, and the first population of cells comprise the second CAR.

18. A method of enhancing expansion of the second population of cells, wherein the second population of cells are cells targeting a solid tumor, the method comprising administering an effective amount of the composition of any one of embodiments 13-17 to a subject having a form of cancer associated with or expressing the tumor antigen.

19. A method of enhancing T cell response in a subject or treating a subject having cancer, the method comprising administering an effective amount of the composition of any one of embodiments 13-17 to the subject having a form of cancer associated with or expressing the tumor antigen.

20. A method of enhancing expansion of cells in a subject, the method comprising: contacting cells with a first vector comprising a first nucleic acid sequence encoding a first CAR and a second vector comprising a second nucleic acid sequence encoding a second CAR to obtain the composition of any one of embodiments 13-17; and administering an effective amount of the composition to the subject having a form of cancer associated with or expresses the tumor antigen.

21. A method of enhancing T cell response in a subject in need thereof or treating a subject having cancer, the method comprising: contacting cells with a first vector comprising a first nucleic acid sequence encoding a first CAR and a second vector comprising a second nucleic acid sequence encoding a second CAR to obtain the composition of any one of embodiments 13-17; and administering an effective amount of the composition to the subject having a form of cancer associated with or expressing the tumor antigen.

22. A method of enhancing expansion of cells in a subject, the method comprising: administering an effective amount of the first population of cells of the composition of any one of embodiments 13-17; and administering an effective amount of the second population of cells.

23. The method of any one of embodiments 20-22, wherein the first vector and the second vector comprise lentiviral vectors.

24. The composition or the method of any one of embodiments 13-23, wherein the first or second antigen is or comprises a surface molecule of a white blood cell (WBC), a tumor antigen, or a solid tumor antigen.

25. The composition or the method of any one of embodiments 13-24, wherein the cells are modified T cells, modified NK cells, modified macrophages, or modified dendritic cells.

26. The composition or the method of embodiment 24, wherein the WBC is a granulocyte, a monocyte, or a lymphocyte.

27. The composition or the method of embodiment 26, wherein the WBC is a B cell.

28. The composition or the method of embodiment 27, wherein the cell surface molecule of the WBC is CD19, CD22, CD20, BCMA, CD5, CD7, CD2, CD16, CD56, CD30, CD14, CD68, CD11b, CD18, CD169, CD1c, CD33, CD38, CD138, or CD13.

29. The composition or the method of embodiment 26, wherein the cell surface molecule of the WBC is CD19, CD20, CD22, or BCMA.

30. The composition or the method of embodiment 26, wherein the cell surface molecule of the WBC is CD19.

31. The composition or the method of embodiment 26, wherein the tumor antigen is a solid tumor antigen.

32. The composition or the method of embodiment 26, wherein the solid tumor antigen is tMUC1, PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Ra2, Mesothelin, PSMA, ROR1, VEGFR-II, GD2, FR-α, ErbB2, EpCAM, EGFRvIII, B7-H3, CLDN18.2, or EGFR.

33. The composition or the method of embodiment 26, wherein the solid tumor antigen is or comprises tMUC1.

34. The composition or the method of any one of embodiments 13-33, wherein the CAR comprises the antigen binding domain, a transmembrane domain, a co-stimulatory domain, and a CD3 zeta domain.

35. The composition or the method of embodiment 34, wherein the co-stimulatory domain comprises the intracellular domain of CD27, CD28, 4-1BB, OX40, CD30, CD40, PD-1, ICOS, lymphocyte function-associated antigen-1 (LFA-1), CD2, CD7, LIGHT, NKG2C, B7-H3, a ligand that specifically binds with CD83, or a combination thereof.

36. The composition or the method of embodiment 34, wherein the co-stimulatory domain of the second CAR comprises or is an intracellular domain of 4-1BB, and the antigen binding domain of the second CAR binds tMUC1; and/or the antigen binding domain of the first CAR binds CD19 and the co-stimulatory domain of the second CAR comprises or is an intracellular domain of CD28.

37. The composition or the method of any one of embodiments 13-36, wherein the first population of cells and/or the second population of cells further comprise a dominant negative form of PD-1.

38. The composition or the method of embodiment 37, wherein the first population of cells comprise a vector encoding the first CAR and the dominant negative form of PD-1.

39. The composition or the method of any one of embodiments 13-38, wherein the first CAR comprises a scFv binding tMUC1, an intracellular domain of 4-1BB or CD28, and a CD3 zeta domain, and the second CAR comprises a scFv binding CD19, an intracellular domain of 4-1BB or CD28, and a CD3 zeta domain.

40. The composition or the method of any one of embodiments 13-39, wherein the first CAR comprises SEQ ID NO: 5, and the second CAR comprise SEQ ID NO: 70.

41. The composition or the method of any one of embodiments 13-40, wherein the second population of cells comprises a lentiviral vector encoding the first CAR and a therapeutic agent and the first population of cells comprises a lentiviral vector encoding the second CAR and a dominant negative form of PD-1.

42. The composition or the method of any one of embodiments 13-41, wherein the first population of cells comprise the first CAR and a therapeutic agent and the second population of cells comprise the second CAR and a dominant negative form of PD-1.

43. The composition or the method of embodiment 41 or 42, wherein the therapeutic agent comprises or is a cytokine.

44. The composition or the method of embodiment 43, wherein the cytokine is IL6 and/or INFγ. 45. A method comprising administering an effective amount of a first population of T cells comprising a CAR comprising a scFv binding CD19, an intracellular domain of 4-1BB or CD28, and a CD3 zeta domain to a subject, thereby enhancing expansion of the first population of T cells in the subject; and administering an effective amount of a second population of T cells comprising a CAR comprising a scFv binding tMUC1, an intracellular domain of 4-1BB or CD28, and a CD3 zeta domain to the patient.

46. The method of embodiment 45, wherein first population of cells further comprises an additional CAR comprising the scFv binding tMUC1, the intracellular domain of 4-1BB or CD28, and the CD3 zeta domain.

47. The method of embodiment 45, wherein the second population of cells does not comprise the scFv binding CD19.

48. The method of embodiment 45, wherein the first population of cells does not comprise the scFv binding tMUC1.

49. A method for enhancing treatment of a subject with cancer, the method comprising: administering to the subject with CAR T cells targeting an antigen of WBC; and administering to the subject tumor infiltrating lymphocytes (TILs).

50. A method for expanding TILs in a subject with cancer, the method comprising: administering to the subject with CAR T cells targeting an antigen of WBC; and administering to the subject tumor infiltrating lymphocytes (TILs). 51. The method of embodiment 49 or 50, wherein the TILs are prepared by:

(i) obtaining a first population of TILs from a tumor resected from the subject; (ii) performing a first expansion by culturing the first population of TILs in a cell culture medium comprising IL-2 to produce a second population of TILs;

(iii) performing a second expansion by supplementing the cell culture medium of the second population of TILs with additional IL-2, OKT-3, and antigen presenting cells (APCs), to produce a third population of TILs, wherein the third population of TILs is at least 100-fold greater in number than the second population of TILs, and wherein the second expansion is performed for at least 14 days in order to obtain the third population of TILs, wherein the third population of TILs is a therapeutic population of TILs which comprises an increased subpopulation of effector T cells and/or central memory T cells relative to the second population of TILs; and (iv) administering a therapeutically effective dosage of the third population of TILs to the subject.

52. The method of embodiment 51, wherein the method further comprises prior to step (iv) a step of performing an additional second expansion by supplementing the cell culture medium of the third population of TILs with additional IL-2, additional OKT-3, and additional APCs, wherein the additional second expansion is performed for at least 14 days to obtain a larger therapeutic population of TILs than obtained in step (iii), wherein the larger therapeutic population of TILs comprises an increased subpopulation of effector T cells and/or central memory T cells relative to the third population of TILs.

53. The method of embodiment 51, wherein after step (ii) the cells are removed from the cell culture medium and cryopreserved in a storage medium prior to the second expansion of embodiment 51.

54. The method of embodiment 53, wherein the cells are thawed prior to the second expansion of embodiment 51.

55. The method of embodiment 51, wherein step (iii) is repeated one to four times in order to obtain sufficient TILs in the therapeutic population of TILs for a therapeutically effective dosage of the TILs.

56. The method of any one of embodiments 49 to 55, wherein the APCs are peripheral blood mononuclear cells (PBMCs).

57. The method of any one of embodiments 49 to 55, wherein the effector T cells and/or central memory T cells exhibit one or more characteristics selected from the group consisting of expression of CD27, expression of CD28, longer telomeres, increased CD57 expression, and decreased CD56 expression, relative to effector T cells and/or central memory T cells in the third population of cells.

58. The method of any one of embodiments 49 to 55, wherein the effector T cells and/or central memory T cells exhibit increased CD57 expression and decreased CD56 expression, relative to effector T cells and/or central memory T cells in the third population of cells.

59. The method of any one of embodiments 49 to 55, wherein the cancer is selected from the group consisting of melanoma, cervical cancer, head and neck cancer, glioblastoma, ovarian cancer, sarcoma, pancreatic cancer, bladder cancer, breast cancer, triple negative breast cancer, and non-small cell lung carcinoma.

60. The method of any one of embodiments 49-59, wherein the CAR binds CD19, CD20, CD22, or BCMA.

Figure 63:
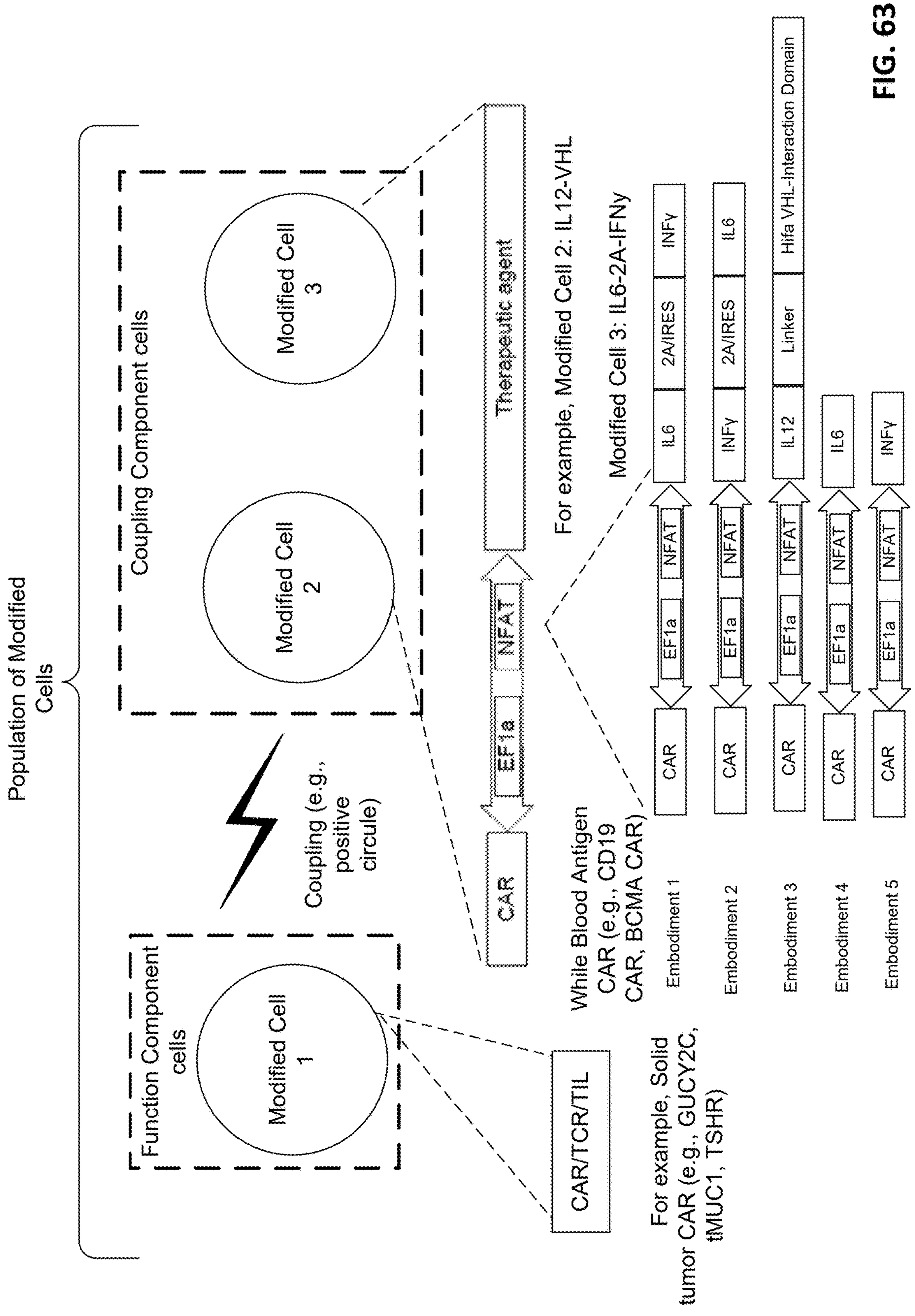
FIG. 63 shows a schematic overview of another implementation of the immunotherapeutic system in FIG. 61.
Figure 64:
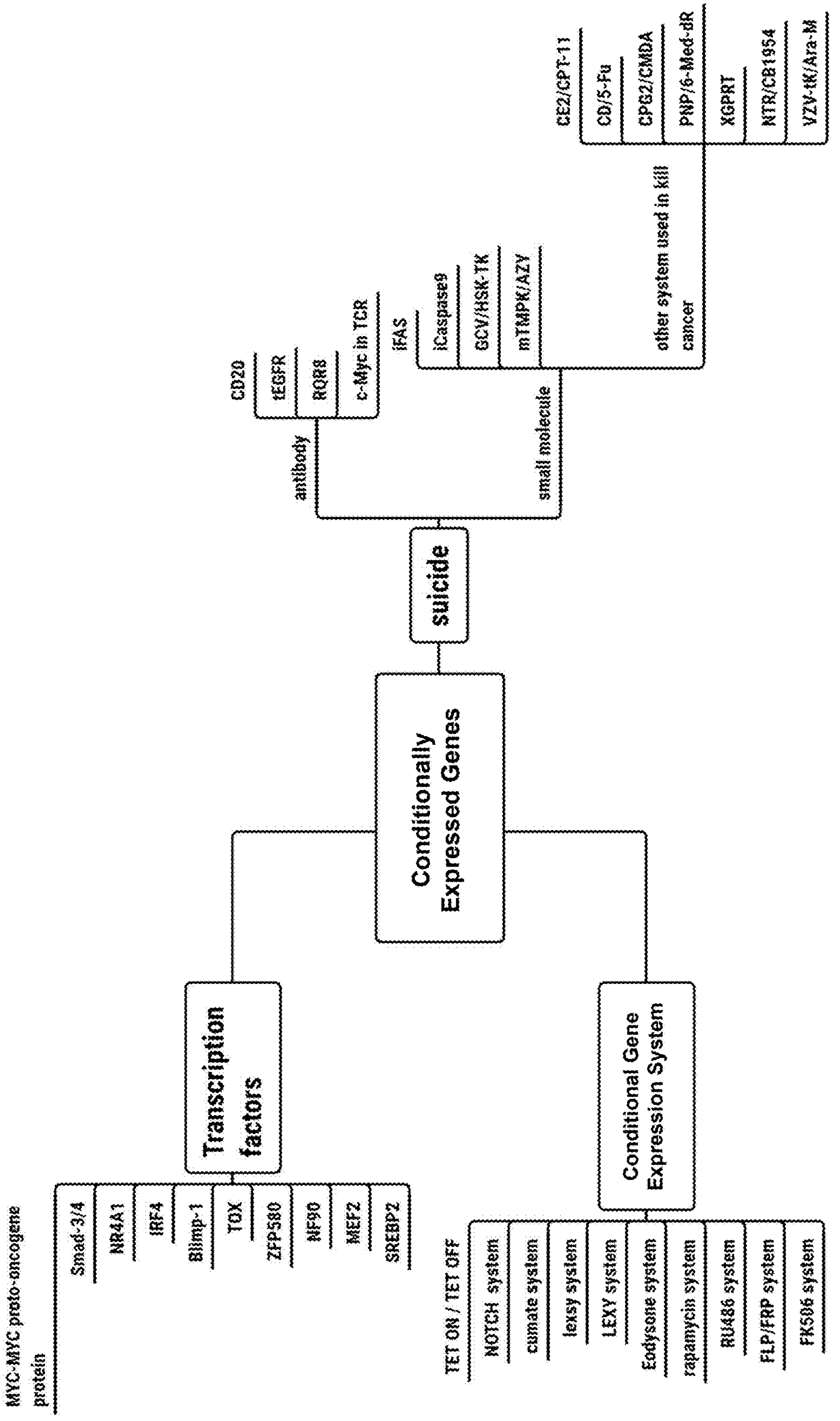
FIG. 64 is a schematic diagram of exemplary conditional gene expression systems.

61. The method of any one of embodiments 49-60, wherein number of TILs in a subject infused with both CAR T cells and TILs is more than number of TILs in a subject infused with TILs. 62. The method of any one of embodiments 49-60, wherein the CAR T cells comprise the modified cell 2 and modified cell 1 of FIG. 63.

63. A method of enhancing expansion of cells in a subject in need thereof or treating a subject having cancer, the method comprising:

administering an effective amount of a composition to the subject having a form of cancer expressing a tumor antigen, the composition comprising a first population of cells comprising a first CAR binding a first antigen, and a second population of cells comprising a second CAR binding a second antigen, wherein the second antigen is a tumor antigen and is different from the first antigen.

64. The method of embodiment 63, wherein the cells are T cells, NK cells, or dendritic cells.

65. The method of embodiment 63, wherein the first antigen comprises a cell surface molecule of a white blood cell (WBC), a tumor antigen, or a solid tumor antigen.

66. The method of embodiment 65, wherein the WBC is a granulocyte, a monocyte, or lymphocyte.

67. The method of embodiment 66, wherein the lymphocyte is a B cell.

68. The method of embodiment 65, wherein the cell surface molecule of the WBC is CD19, CD22, CD20, BCMA, CD5, CD7, CD2, CD16, CD56, CD30, CD14, CD68, CD11b, CD18, CD169, CD1c, CD33, CD38, CD138, or CD13.

69. The method of embodiment 65, wherein the cell surface molecule of the WBC is CD19, CD20, CD22, or BCMA.

70. The method of embodiment 65, wherein the cell surface molecule of the WBC is CD19.

71. The method of embodiment 63, wherein the tumor antigen is a solid tumor antigen.

72. The method of embodiment 71, wherein the solid tumor antigen is tMUC1, PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Ra2, Mesothelin, PSMA, ROR1, VEGFR-II, GD2, FR-α, ErbB2, EpCAM, EGFRvIII, B7-H3, CLDN18.2, or EGFR.

73. The method of embodiment 71, wherein the solid tumor antigen comprises tMUC1.

74. The method of embodiment 63, wherein the CAR comprises an antigen binding domain, a transmembrane domain, a co-stimulatory domain, and a CD3 zeta domain.

75. The method of embodiment 74, wherein the co-stimulatory domain comprises the intracellular domain of CD27, CD28, 4-1BB, OX40, CD30, CD40, PD-1, ICOS, lymphocyte function-associated antigen-1 (LFA-1), CD2, CD7, LIGHT, NKG2C, B7-H3, a ligand that binds CD83, or a combination thereof.

76. The method of embodiment 63, wherein the first CAR comprises a scFv binding CD19, an intracellular domain of 4-1BB or CD28, and a CD3 zeta domain, and the second CAR comprises a scFv binding tMUC1, an intracellular domain of 4-1BB or CD28, and a CD3 zeta domain.

77. The method of embodiment 63, wherein an antigen binding domain of the first CAR comprises SEQ ID NO: 5 and an antigen binding domain of the second CAR comprises SEQ ID NO: 70.

78. The method of embodiment 63, wherein the second population of cells comprises a lentiviral vector encoding the second CAR and a dominant negative form of PD-1.

79. The method of embodiment 63, wherein the first population of cells comprises a lentiviral vector encoding the first CAR and a therapeutic agent.

80. The method of embodiment 79, wherein the therapeutic agent comprises a cytokine.

81. The method of embodiment 80, wherein the cytokine is IL6 and/or INFγ.

82. The method of embodiment 80, wherein the cytokine is at least one of IL6, IL12, IL7, IL15, TNF-α, or IFNγ.

83. A method for in vitro cell preparation, the method comprising: contacting cells with (1) a first vector comprising a polynucleotide encoding a first antigen binding molecule that binds a first antigen and (2) a second vector comprising a polynucleotide encoding a second antigen binding molecule that binds a second antigen to obtain a population of modified cells, to obtain a mixed population of modified cells, wherein the first antigen is different from the second antigen. 84. A method for enhancing cell expansion in a subject having cancer, the method comprising: obtaining cells from the subject or a healthy donor; contacting the cells with (1) a first vector comprising a polynucleotide encoding a first antigen binding molecule that binds a first antigen and (2) a second vector comprising a polynucleotide encoding a second antigen binding molecule that binds a second antigen to obtain a mixed population of modified cells; and administering an effective amount of the mixed population of modified cells to the subject; wherein: the first antigen is different from the second antigen; and a level of the cell expansion in the subject is higher than a level of the cell expansion in a subject administered an effective amount of a population of modified cells that have been contacted with the first vector but not the first vector.

85. A method for treating a subject having cancer, the method comprising: obtaining cells from the subject or a healthy donor; contacting the cells with (1) a first vector comprising a polynucleotide encoding a first antigen binding molecule that binds a first antigen and (2) a second vector comprising a polynucleotide encoding a second antigen binding molecule that binds a second antigen to obtain a mixed population of modified cells; and administering an effective amount of the mixed population of modified cells to the subject; wherein: the first antigen is different from the second antigen.

86. A method for enhancing treatment of a subject having cancer, the method comprising: obtaining cells from the subject or a healthy donor; contacting the cells with (1) a first vector comprising a polynucleotide encoding a first antigen binding molecule that binds a first antigen and (2) a second vector comprising a polynucleotide encoding a second antigen binding molecule that binds a second antigen to obtain a mixed population of modified cells; and administering an effective amount of the mixed population of modified cells to the subject; wherein: the first antigen is different from the second antigen; and a level of inhibition of tumor growth in the subject is higher than a level of inhibition of tumor growth in a subject administered with an effective amount of a population of modified cells that have been contacted with the second vector but not the first vector.

87. A method for in vitro cell preparation, the method comprising: introducing a first vector comprising a polynucleotide encoding a first antigen binding molecule that binds a first antigen into a first population of cells; and introducing a second vector comprising a polynucleotide encoding a second antigen binding molecule that binds a second antigen into a second population of cells; and culturing the first and second population of cells separately; wherein the first antigen is different form the second antigen.

88. A method for enhancing cell expansion in a subject having cancer, the method comprising: introducing a first vector comprising a polynucleotide encoding a first antigen binding molecule that binds a first antigen into a first population of cells to obtain a first population of modified cells; introducing a second vector comprising a polynucleotide encoding a second antigen binding molecule that binds a second antigen into a second population of cells to obtain a second population of modified cells; and administering an effective amount of the first and second population of modified cells to the subject; wherein: the first antigen is different from the second antigen; and a level of the cell expansion in the subject is higher than a level of the cell expansion in a subject administered an effective amount of the second population of modified cells but not the first population of modified cells. In embodiments, the first population of modified cells and the second population of modified cells are administered simultaneously or sequentially.

89. A method for treating a subject having cancer, the method comprising: introducing a first vector comprising a polynucleotide encoding a first antigen binding molecule that binds a first antigen into a first population of cells to obtain a first population of modified cells; introducing a second vector comprising a polynucleotide encoding a second antigen binding molecule that binds a second antigen into a second population of cells to obtain a second population of modified cells; and administering an effective amount of the first and second population of modified cells to the subject; wherein the first antigen is different from the second antigen. In embodiments, the first population of modified cells and the second population of modified cells are administered simultaneously or sequentially.

90. A method for enhancing treatment of a subject having cancer, the method comprising: introducing a first vector comprising a polynucleotide encoding a first antigen binding molecule that binds a first antigen into a first population of cells to obtain a first population of modified cells; introducing a second vector comprising a polynucleotide encoding a second antigen binding molecule that binds a second antigen into a second population of cells to obtain a second population of modified cells; and administering an effective amount of the first and second population of modified cells to the subject, wherein: the first antigen is different from the second antigen; and a level of inhibition of tumor growth in the subject is higher than a level of inhibition of tumor growth in a subject administered with an effective amount of the second population of modified cells in the absence of the first population of modified cells. In embodiments, the first population of modified cells and the second population of modified cells are administered simultaneously or sequentially.

91. A method for enhancing T cell response, the method comprising: introducing a first vector comprising a polynucleotide encoding a first antigen binding molecule that binds a first antigen into a first population of cells; introducing a second vector comprising a polynucleotide encoding a second antigen binding molecule that binds a second antigen into a second population of cells; contacting cells expressing the second antigen with the first population of cells and the second population of cells; and measuring a level of the T cell response, wherein the level of T cell response is higher in the contacted cells than a level of the T cell response in cells contacted with the second population of cells without the first population of cells.

92. A method for enhancing T cell response, the method comprising: contacting a population of cells with a first vector comprising a polynucleotide encoding a first antigen binding molecule that binds a first antigen and a second vector comprising a polynucleotide encoding a second antigen binding molecule that binds a second antigen to obtain a mixed population of modified cells; contacting cells expressing the second antigen with the mixed population of modified cells; and measuring a level of the T cell response, wherein the level of T cell response is higher in the contacted cells than a level of the T cell response in cells contacted with the a population of cells contacted with the second vector without the first vector.

93. The method of any one of embodiments 83-92, wherein the cells are T cells, NK cells, or dendritic cells. In embodiments, the cells T cells.

94. The method of any one of embodiments 83-93, wherein the first antigen binding molecule binds a cell surface molecule of a WBC.

95. The method of embodiment 94, wherein the WBC is a granulocyte, a monocyte, or lymphocyte.

96. The method of embodiment 94, wherein the WBC is a B cell.

97. The method of embodiment 94, wherein the cell surface molecule of the WBC is CD19, CD22, CD20, BCMA, CD5, CD7, CD2, CD16, CD56, CD30, CD14, CD68, CD11b, CD18, CD169, CD1c, CD33, CD38, CD138, or CD13.

98. The method of embodiment 94, wherein the cell surface molecule of the WBC is CD19, CD20, CD22, or BCMA.

99. The method of embodiment 94, wherein the cell surface molecule of the WBC is CD19.

100. The method of any one of embodiments 83-99, wherein the second antigen binding molecule binds to a solid tumor antigen.

101. The method of embodiment 100, wherein the solid tumor antigen is tMUC1, PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Ra2, Mesothelin, PSMA, ROR1, VEGFR-II, GD2, FR-α, ErbB2, EpCAM, EGFRvIII, CLDN18.2, or EGFR.

102. The method of any one of embodiments 83-101, wherein the first and second binding molecules are CARs.

103. The method of embodiment 102, wherein the CAR comprises an extracellular domain, a transmembrane domain, and an intracellular domain, and the extracellular domain binds a tumor antigen.

104. The method of embodiment 103, wherein the intracellular domain comprising a co-stimulatory domain that comprises an intracellular domain of a co-stimulatory molecule selected from the group consisting of CD27, CD28, 4-1BB, OX40, CD30, CD40, PD-1, ICOS, lymphocyte function-associated antigen-1 (LFA-1), CD2, CD7, LIGHT, NKG2C, B7-H3, or a combination thereof.

105. The method of embodiment 105, wherein the intracellular domain comprises a CD3 zeta signaling domain.

106. The method of any one of embodiments 83-101, wherein the first binding molecule is a CAR, and the second binding molecule is a TCR.

107. The method of embodiment 106, wherein the T cell comprises a modified T Cell Receptor (TCR).

108. The method of embodiment 106, wherein the TCR is derived from spontaneously occurring tumor-specific T cells in patients.

109. The method of embodiment 106, wherein the TCR binds a tumor antigen.

110. The method of embodiment 109, wherein the tumor antigen comprises CEA, gp100, MART-1, p53, MAGE-A3, or NY-ESO-1.

111. The method of embodiment 106, wherein the TCR comprises TCRY and TCRo chains, TCRα and TCRβ chains, or a combination thereof.

112. The method of embodiment 106, wherein the second population of cells are derived from TILs.

113. The method of any one of embodiments 83-112, wherein the population of modified cells comprise cells comprising the first binding molecule and cells comprising the second binding molecules.

114. The method of any one of embodiments 83-112, wherein the population of modified cells comprise cells comprising the first binding molecule, cells comprising the second binding molecules, and cells comprising both the first binding molecule and the second binding molecule.

115. The method of any one of embodiments 83-112, wherein the T cell response is measured by the number of copies of CAR(s) and/or the amount of cytokine released. In embodiments, the cytokine released are IL-6 and/or IFNγ.

116. The method of any one of embodiments 83-112, wherein the T cell response comprises cytokine release, cell expansion, and/or activation levels.

117. The method of any one of embodiments 83-112, wherein the first vector further comprises a polynucleotide encoding IL-6, IFNγ, or a combination thereof.

118. The method of any one of embodiments 83-112, wherein the first vector further comprises a polynucleotide encoding IL-12.

119. The method of any one of embodiments 116 and 117, wherein the polynucleotide comprises a polynucleotide encoding NFAT and/or VHL.

120. The method of any one of embodiments 83-119, wherein the population of modified cells comprise cells expressing the first binding molecule and IL-6, IFNγ, or a combination thereof, cells expressing the second binding molecules, cells expressing the first and second molecules, and/or cells expressing the first binding molecule and IL-12.

121. The method of any one of embodiments 83-120, wherein the population of modified cells comprise cells expressing the second binding molecule and IL-6, IFNγ, or a combination thereof, cells expressing the second binding molecules, cells expressing the first and second molecules, and/or cells expressing the first binding molecule and IL-12.

122. The method of any one of embodiments 83-121, wherein the population of modified cells comprise cells expressing the second binding molecule and IL-6, IFNγ, or a combination thereof, cells expressing the second binding molecule, cells expressing the first and second molecules, and/or cells expressing the second binding molecule and IL-12.

123. The method of any one of embodiments 83-122, wherein the population of modified cells comprise cells expressing a dominant negative form of PD-1.

124. A bispecific chimeric antigen receptor, comprising: a first antigen binding domain, a second antigen binding domain, a cytoplasmic domain, and transmembrane domain, wherein the first antigen binding domain recognizes a first antigen, and the second antigen binding domain recognize a second antigen, and the first antigen is different from the second antigen.

125. The bispecific chimeric antigen receptor of embodiment 124, wherein the first antigen and the second antigen are not expressed on the same cell.

126. The bispecific chimeric antigen receptor of embodiment 124 or 125, wherein the first antigen is an antigen of a blood component, and the second antigen is an antigen of a solid tumor.

127. The bispecific chimeric antigen receptor of any one of embodiments 124-126, wherein the first antigen is CD19, and the second antigen is a tumor associated MUC1.

128. The bispecific chimeric antigen receptor of any one of embodiments 124-128, wherein the first antigen binding domain comprises amino acid sequence SEQ ID: 5 or 6.

129. The bispecific chimeric antigen receptor of any one of embodiments 124-128, wherein the second antigen binding domain comprises one of amino acid sequence SEQ ID: 70, 71, 72, 79, 80, or 81.

130. The bispecific chimeric antigen receptor of embodiment 124, wherein the CAR comprises amino acid sequence of any one of tanCARs listed in Table 5.

131. The bispecific chimeric antigen receptor of embodiment 124, wherein the first binding domain binds an antigen of nonessential tissues, and the second binding domain binds an antigen of tumor tissue. In embodiments, the first binding domain binds TSHR or GUCY2C. In embodiments, the second binding domain binds tMUC1, MAGE-E1, or Epithelial tumor antigen (ETA).

132. The bispecific chimeric antigen receptor of embodiment 124, wherein the first binding domain binds a tissue specific antigen, and the second binding domain binds an antigen expressed on more than one tissue. In embodiments, the first binding domain binds TSHR or PRLR. In embodiments, the second binding domain binds tMUC1, MAG-E1, or ETA. 133. The bispecific chimeric antigen receptor of embodiment 124, wherein the first binding domain binds an antigen of normal tissue, and the second binding domain binds an antigen expressed on tumor tissue. In embodiments, the first binding domain binds ACPP, TSHR, GUCY2C, UPK2, CLDN18.2, PSMA, DPEP3, CXCR5, B7-H3, MUC16, SIGLEC-15, CLDN6, Muc17, PRLR, or FZD10. In embodiments, the second binding domain binds tMUC1, MAG-E1, or ETA.

134. The bispecific chimeric antigen receptor of any one of embodiments 123, wherein the first binding domain binds to an antigen that is expressed on non-malignant cells, and the second binding domain binds an antigen that is expressed on tumor cells and not on corresponding non-malignant cells.

135. A cell comprising the bispecific CAR of any one of embodiments 123-134.

136. A nucleic acid encoding the bispecific CAR of any one of embodiments 123-134.

137. A method of enhancing T cell response, enhancing treatment of cancer, treating cancer in a subject, treating a subject having a tumor, or inhibiting the growth of a tumor, the method comprising: administering an effective amount of cell of embodiment 135.

136. The use of the cell, the bispecific CAR, population of modified cells, the composition, or the method of any one of embodiments 1-135 for the treatment of a subject in need thereof.

137. The use of the cell, the bispecific CAR, population of modified cells, the composition, or the method of embodiment 136, wherein the subject has cancer.

EXAMPLES

Example 1. Bispecific CARs

Lentiviral vectors that encode individual CAR molecules were generated and transfected with T cells, which are elaborated below. Techniques related to cell cultures, construction of cytotoxic T lymphocyte assay may be found in "Control of large, established tumor xenografts with genetically retargeted human T cells containing CD28 and CD137 domains," PNAS, Mar. 3, 2009, vol. 106 no. 9, 3360-3365 and "Chimeric Receptors Containing CD137 Signal Transduction Domains Mediate Enhanced Survival of T Cells and Increased Antileukemic Efficacy In Vivo," Molecular Therapy, August 2009, vol. 17 no. 8, 1453-1464, which are incorporated herein by reference in its entirety.

Figure 7:
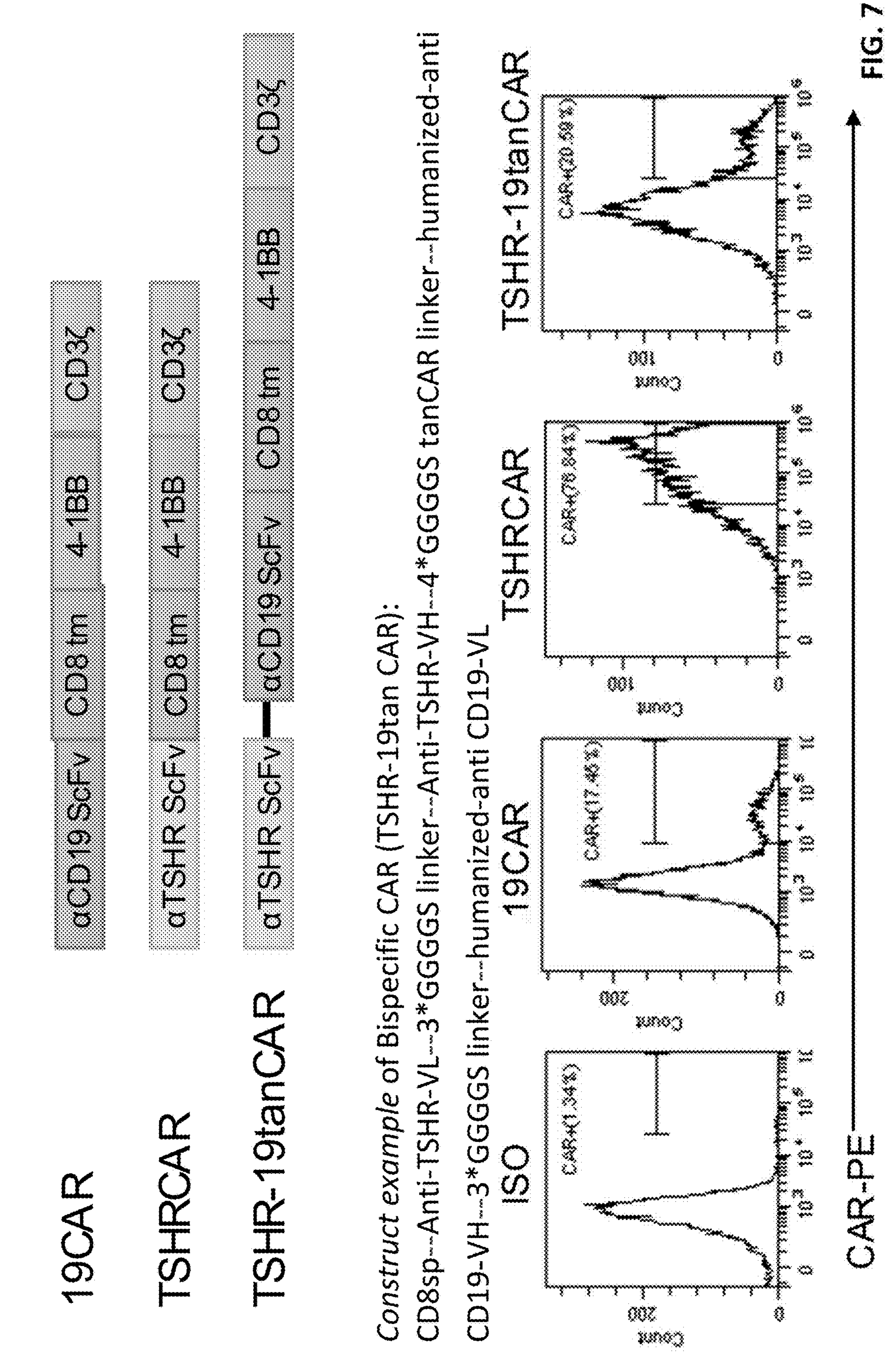
FIG. 7 shows a design of the bispecific CAR and results of expression assays. 3*GGGGS ($(GGGGS)_3$) is set forth in SEQ ID NO: 124, and 4*GGGGS ($(GGGGS)_4$) is set forth in SEQ ID NO: 431.
Figure 10:
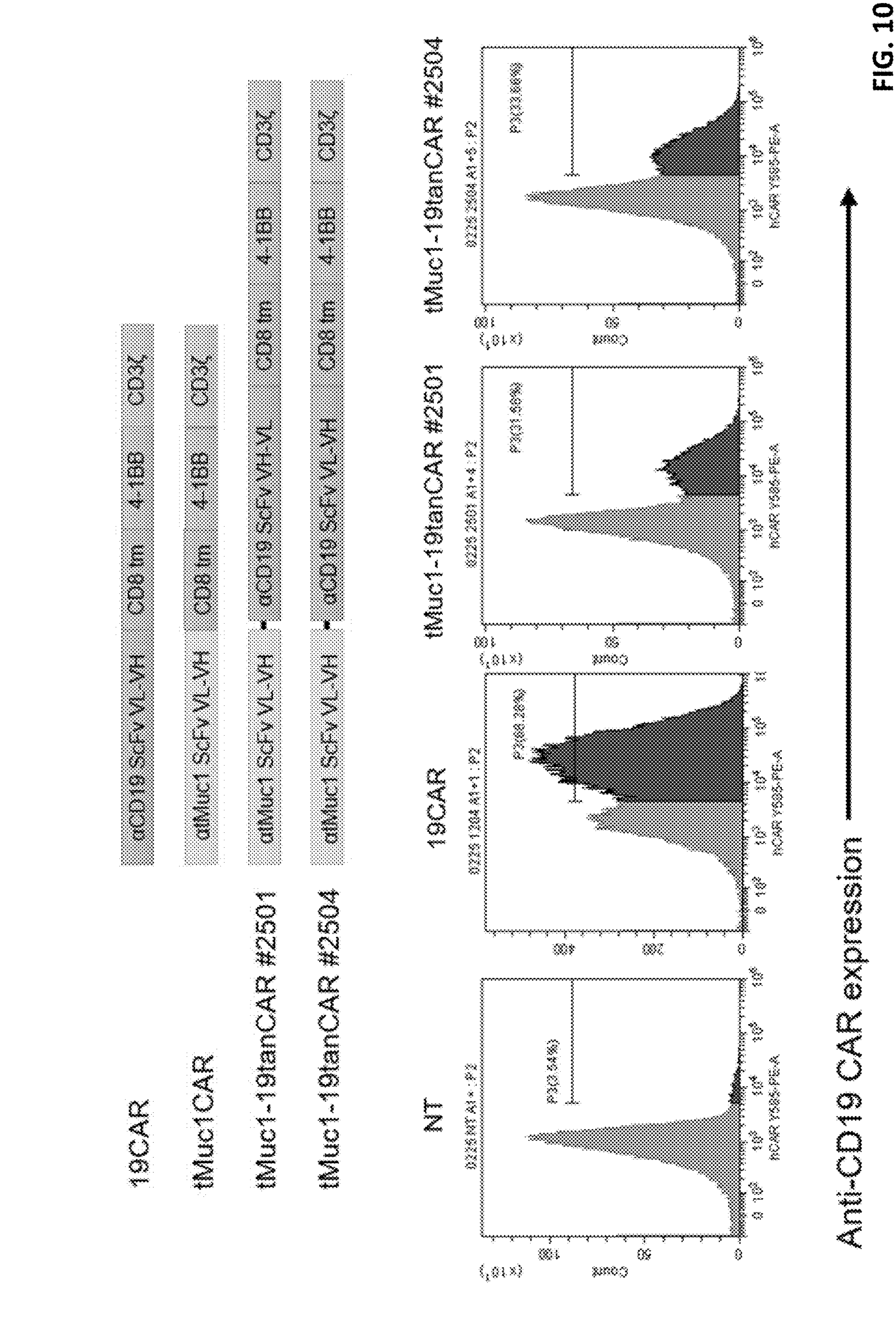
FIG. 10 shows another design of bispecific CAR and results of expression assays.
Figure 11:
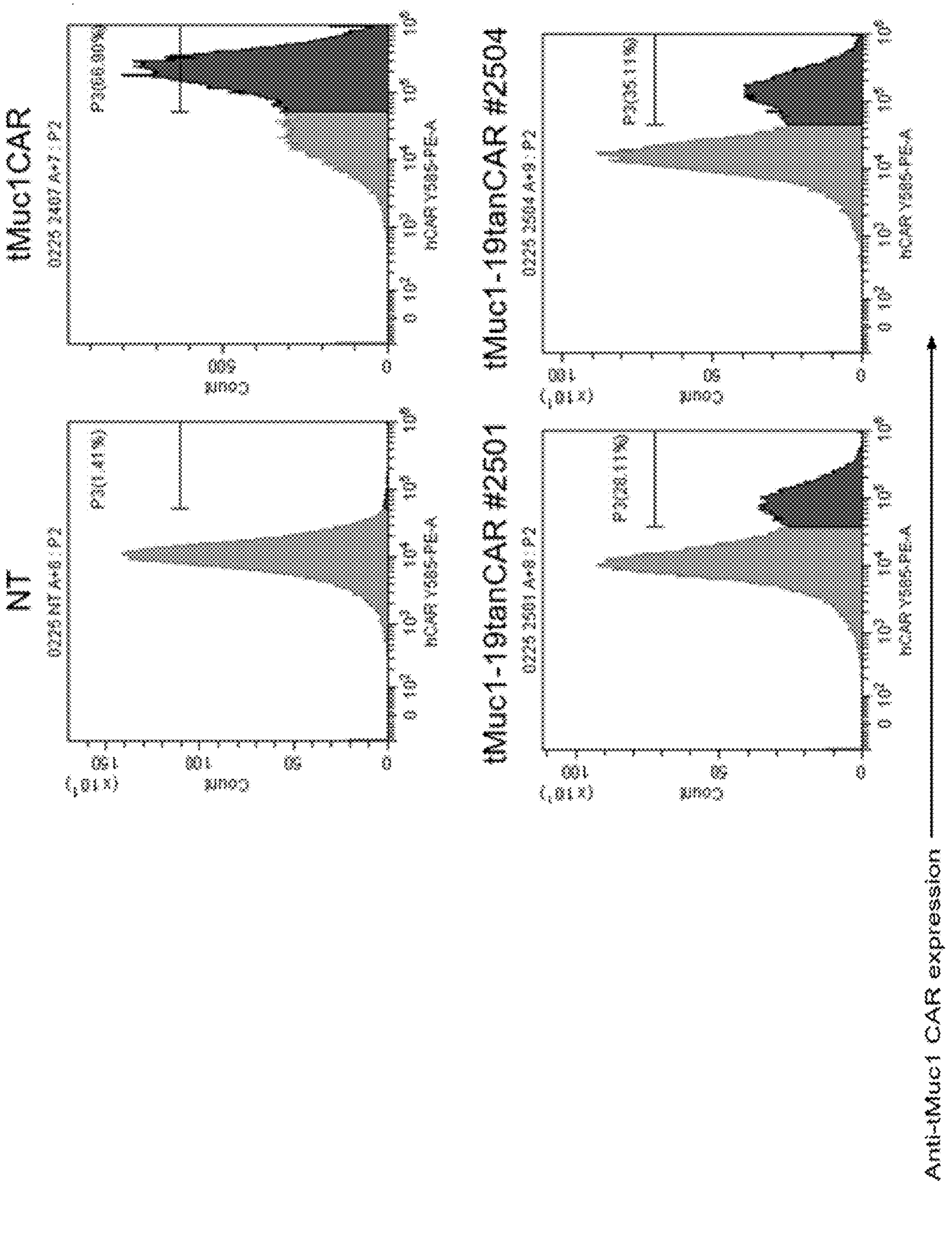
FIG. 11 shows results of an expression assay of the bispecific CAR used in the assay of FIG. 10.

On Day 0, peripheral blood was drawn from healthy volunteers and sorted to collect CD3+ T cells. CD3/CD28 Dynabeads was added to the collected CD3+ T cells in a 1:1 ratio. On Day 1, the activated CD3+ T cells were transfected with vectors including CD19 CAR (MOI=15; the binding domain of the CAR being SEQ ID NO: 5) and vectors including TSHR CAR (MOI=92; the binding domain of the CAR being SEQ ID NO: 8), and vectors including TSHR-CD19 bispecific CAR (MOI=92; the binding domain of the CAR being SEQ ID NO: 435). More structure and sequence information are provided in FIG. 7 and Table 5. On Day 2, culture media were changed., The lentivirus was removed, and the cells were resuspended in fresh media. On Day 5, flow detection of CAR expression was performed. Various expression rates were observed (CD19 CAR 17.45%, TSHR CAR 76.84%, and TSHR-CD19 bispecific CAR 20.59%). Also, on Day 0, peripheral blood was drawn from healthy volunteers and sorted to collect CD3+ T cells. CD3/CD28 Dynabeads were added to the collected CD3+ T cells in a 1:1 ratio. On Day 1, the activated CD3+ T cells were transfected with vectors including CD19 CAR (MOI=2; the binding domain of the CAR being SEQ ID NO: 5) and vectors including tMUC1 CAR (MOI=30; the binding domain of the CAR being SEQ ID NO: 70), and vectors including tMUC1-CD19 bispecific CAR (MOI=95; the binding domain of the CAR being SEQ ID NO: 437), and vectors including CLDN18.2-CD19 (18.2-CD19) bispecific CAR (MOI=180, the binding domain of the CAR being SEQ ID No: 439). More sequence information is provided in FIGS. 10, 12, and 13 and Table 5. On Day 2, culture media were changed. The lentivirus was removed, and the cells were resuspended in fresh media. On Day 5, flow detection of CAR expression was performed. Various expression rates were observed (CD19CAR 68.28%, tMUC1CAR 31.58%, and tMUC1CD19 bispecific CAR 28.11% and 35.11%).

Figure 8:
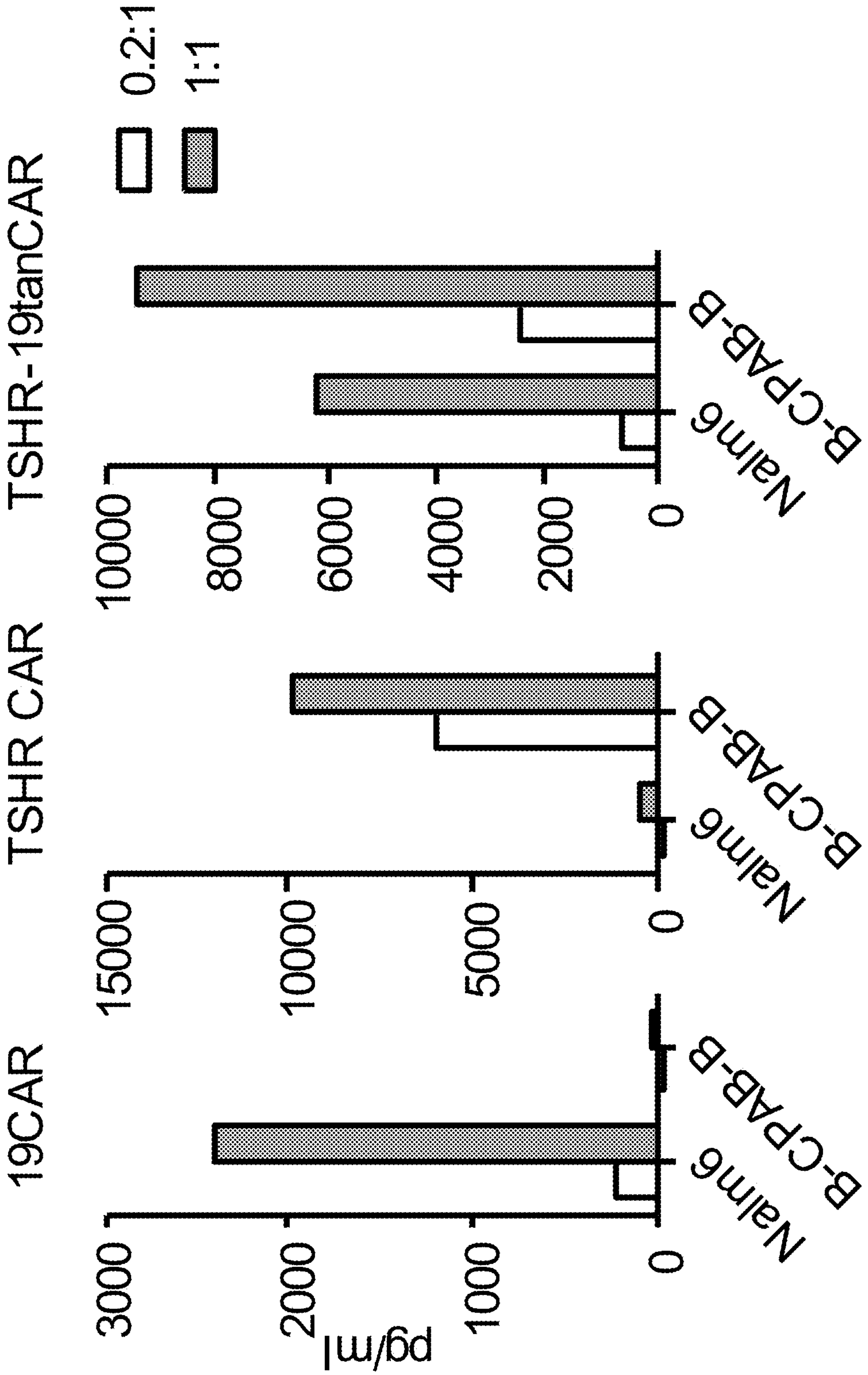
FIG. 8 shows cytokine release of T cells expressing a bispecific CAR.
Figure 9:
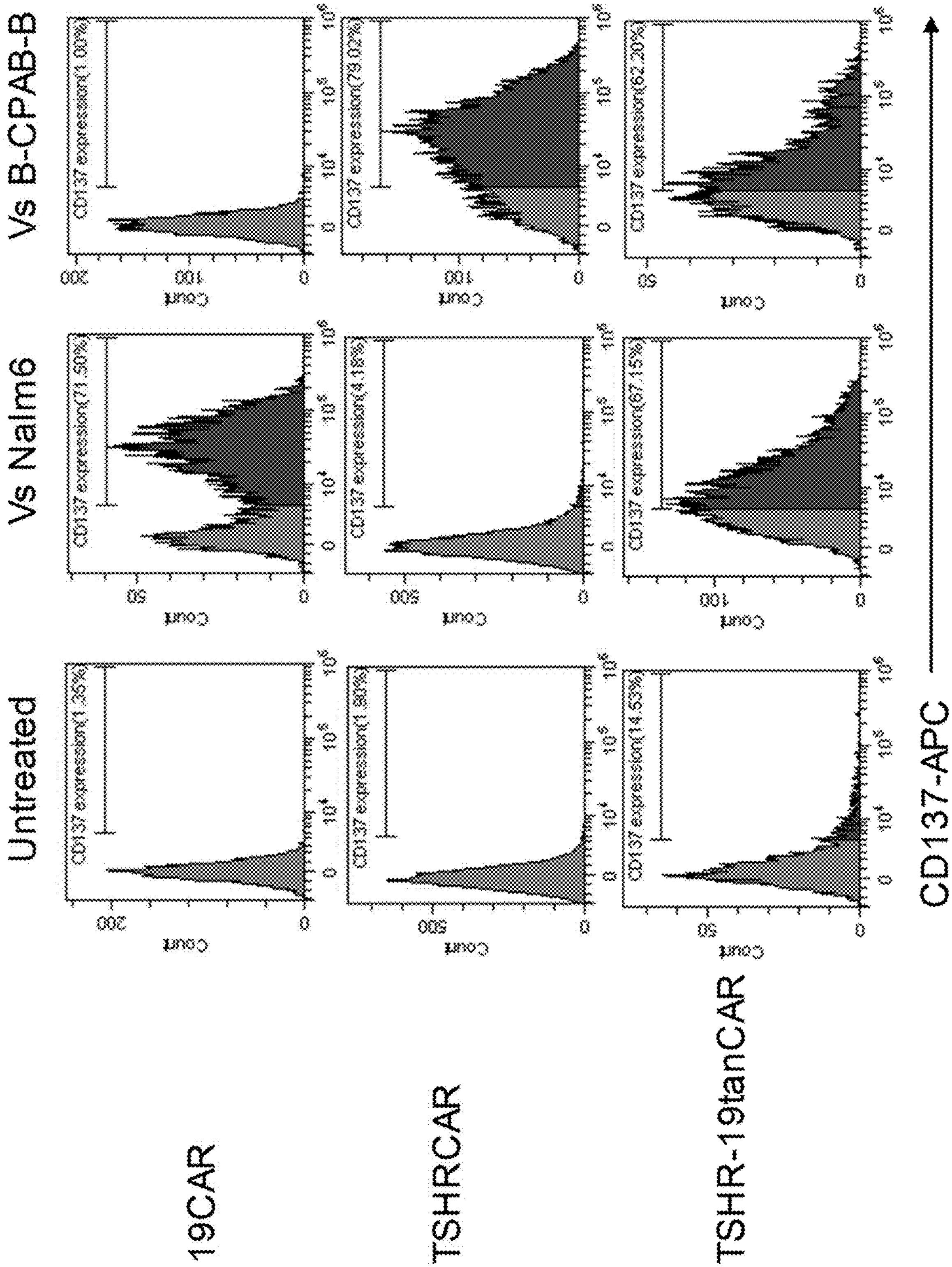
FIG. 9 shows results of co-culturing assay of T cells expressing a bispecific CAR and corresponding target cells.

As shown in FIG. 8, 0.2 or $1\times10^4$ CAR T cells and $1\times10^4$ Nalm6 or B-CPAB-B tumor cells were co-cultured for 24 hours (hrs), and the supernatant was collected. IFNγ release was detected. Nalm6 was a CD19-positive tumor cell, and B-CPAB-B was a TSHR positive tumor cell. As shown in the left panel of FIG. 8, CD19 CAR T cells released more IFNγ in response to Nalm6 as compared to that released in response to B-CPAB-B. As shown in the middle panel, TSHR CAR T cells released more IFNγ in response to B-CPAB-B as compared to that released in response to Nalm6. As shown in the right panel, bispecific CAR T cells released significant amount of IFNγ in response to each of Nalm6 and B-CPAB-B. These results indicated that bispecific CAR T cells can be stimulated by both CD19-positive or TSHR-positive cells. 105 CAR T cells and 105 Nalm6 or B-CPAB-B tumor cells were co-cultured for 24 hours, and CD137 expression of CAR T CD8 positive cells was then detected by flow cytometry. The left panel of FIG. 9 showed CD137 expression of CAR T cells not co-cultured with tumor cells, while the middle and right showed CD137 expression of CAR T cells co-cultured with Nalm6 or B-CPAB-B. The results demonstrated that bispecific CAR T (TSHR-CD19 bispecific CAR) were activated by both Nalm6 and B-CPAB-B. Similar cytokine release assays were performed and showed that bispecific CAR T (CLDN18.2-CD19 bispecific CAR or CLDN18.2-19 tan CAR) cells were activated by both Nalm6 and cells expressing CLDN18.2 (FIGS. 12-15).

Figure 13:
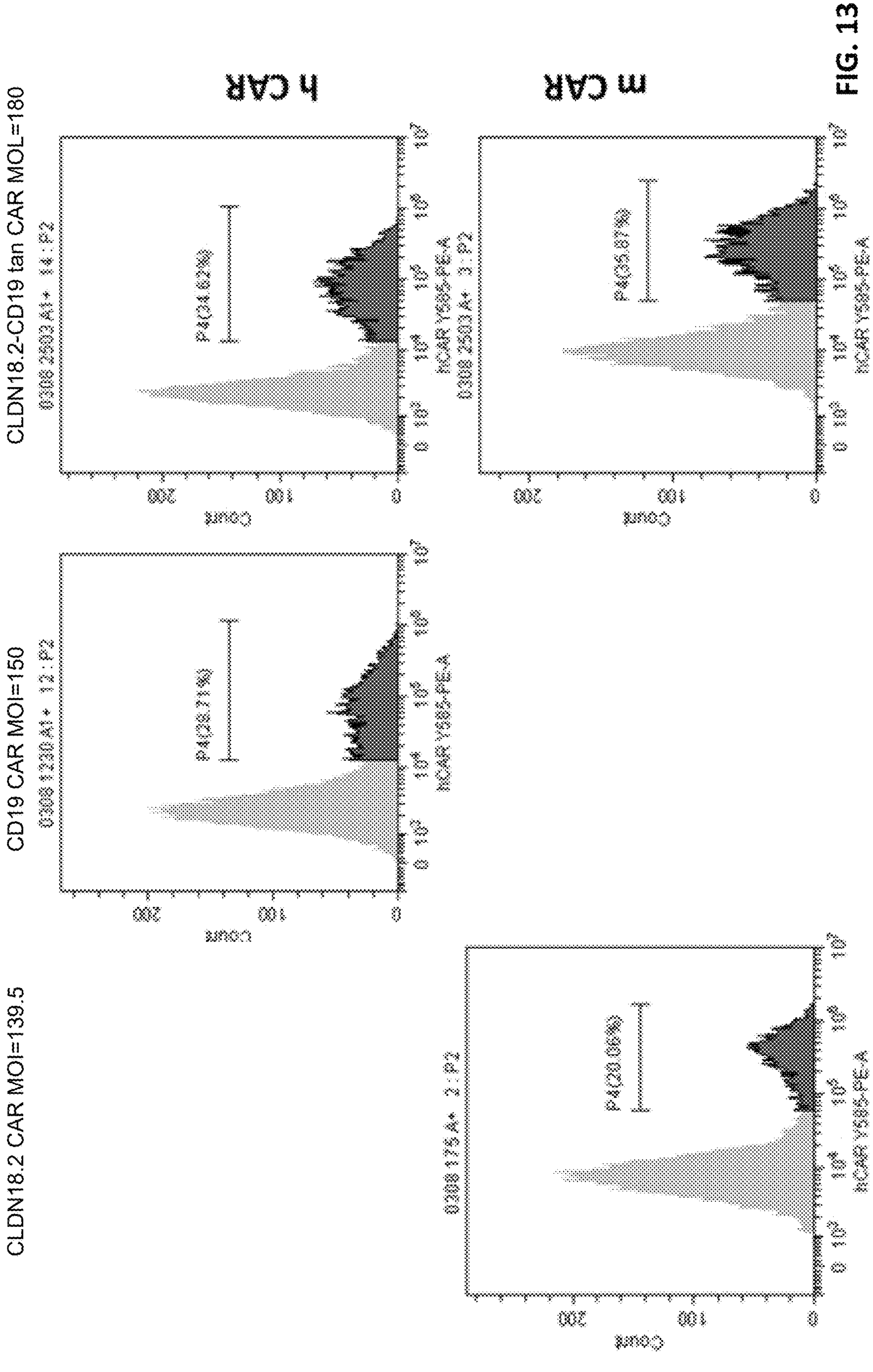
FIG. 13 shows expression of the CAR molecules shown in FIG. 12.
Figure 14:
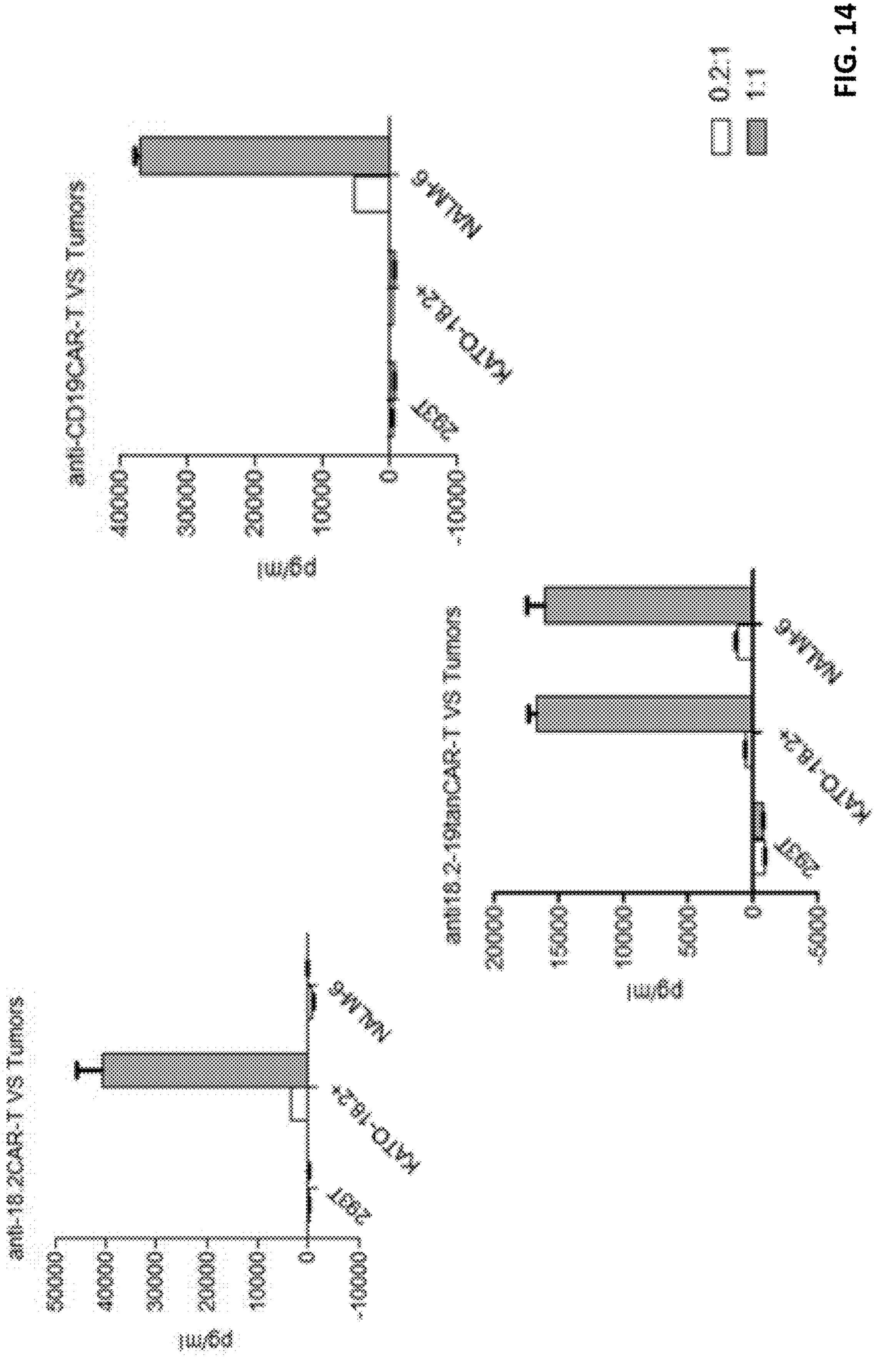
FIG. 14 shows results of IFNγ (IFNg) release of co-culturing CAR T cells with tumor cells.

FIG. 12 shows schematic structure of constructs of vectors encoding CAR molecules. FIG. 13 shows expression of the CAR molecules shown in FIG. 12. Since CD19 CAR included a humanized antibody, 18.2 CAR is a murine antibody. Therefore, human and murine CAR antibodies were used for detection. The ratio of expression of the two antibodies was detected with bispecific CAR, which was close to 1:1, indicating that the expression of bispecific CAR was as expected. FIG. 14 shows results of IFNγ release of co-culturing CAR T cells and tumor cells. The experiment was carried out by co-culturing with 0.2 or $1\times10^4$ CAR T cells and $1\times10^4$ 293T or KATO III-18.2+ or Nalm-6 cells. The supernatant was collected after 24 hrs to detect IFN-γ. Nalm-6 is a CD19 T cell; KATO III-18.2+ is a cell that overexpresses CLDN18.2; and 293T is a double-negative cell that does not express CD19 and CLDN18.2. As shown, 18.2 CAR T showed significant IFN-γ release when co-cultured with KATOIII-18.2+ cells, indicating that KATOIII-18.2+ can be recognized by 18.2 CAR T cells and released IFN-γ to kill target cells; Nalm-6 was also recognized by CD19 CAR T cells and released IFN-γ to kill target cells; 18.2-CD19 bispecific CAR (18.2-19 tan CAR) had significant IFN-γ release when co-cultured with KATOIII-18.2+ and Nalm-6. In addition, Nalm-6 could not stimulate the release of IFN-γ from 18.2 CAR T cells, and CD19 CAR T cells could not stimulate the release of IFN-γ by KATO III-18.2+, indicating that both CAR T cells are specific. In conclusion, 18.2-CD19 bispecific CAR T cells can specifically recognize 18.2 and CD19-positive target cells, and release IFN-γ to kill target cells.

Figure 15:
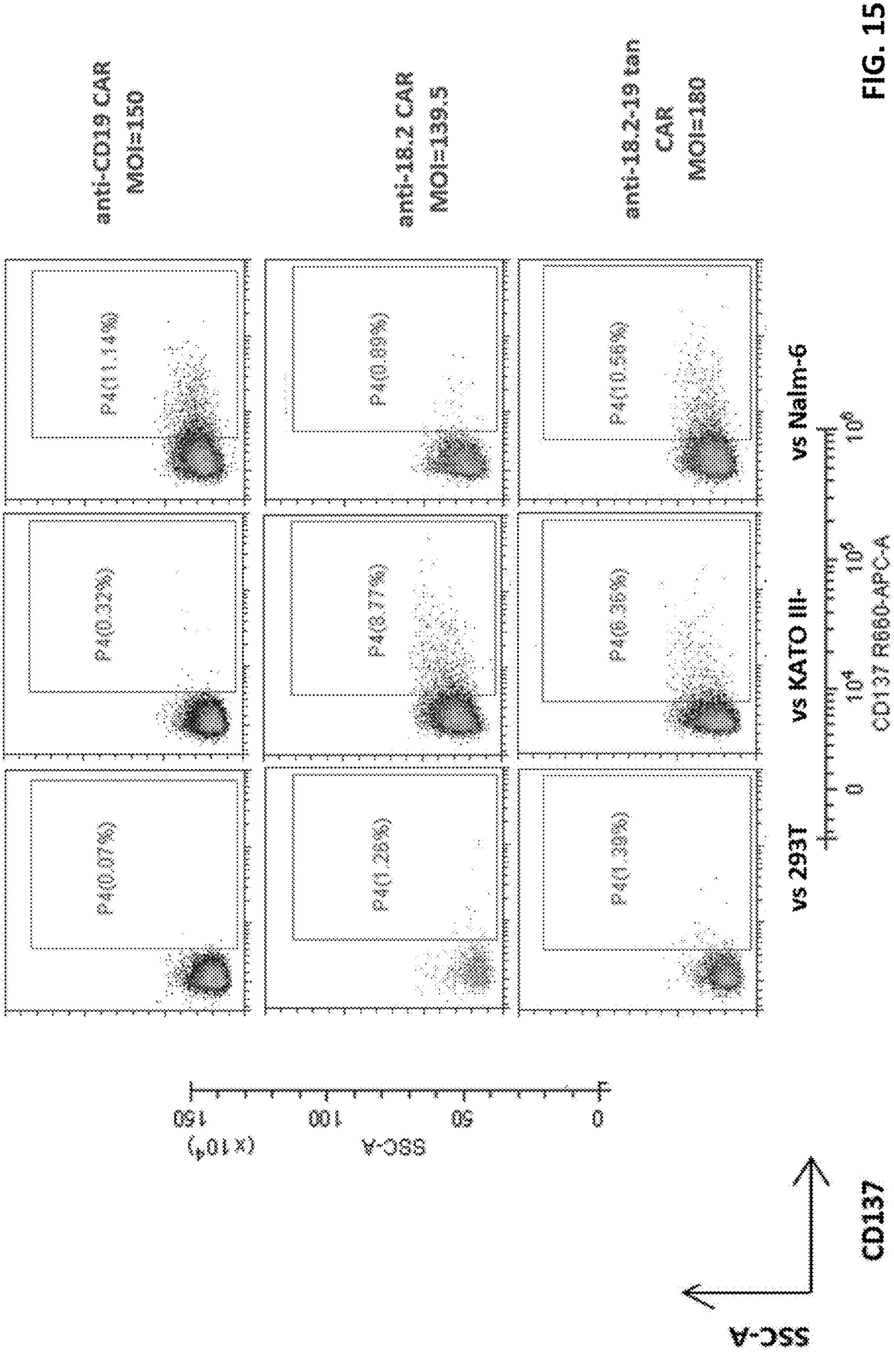
FIG. 15 shows flow cytometry results depicting CD137 expression for co-culturing of CAR T cells and tumor cells.

FIG. 15 shows flow cytometry results depicting CD137 expression for co-culturing of CAR T cells and tumor cells. $1\times10^4$ CAR T cells were co-cultured with $1\times10^4$ 293T-WT or KATOIII-18.2+ or Nalm-6 cells. CD137 expression of CAR T CD8+ cells was measured by flow cytometry after 48 Hours. The left column shows CD137 expression of CAR T cells co-cultured with 293T. CD19 CAR expression is absent in the CD19 CAR group, the 18.2 CAR group, and the 18.2-19 tan CAR group. It can be seen that the 293T has no specific antigen expression and cannot activate CAR T cells. In the middle column, CAR T cells were co-cultured with KATO III-18.2+ cells with high expression of 18.2 protein. The expression of CD137 in the 18.2 CAR group was 8.77%, and the expression of CD137 in the 18.2-19 bispecific CAR group was 6.36%. The expression of CD137 was not observed in the CD19 CAR group. 18.2-CAR T and 18.2-CD19 bispecific CAR T recognized and activated the 18.2 protein in KATOIII-18.2+; CD19 CAR T did not. The right column is a co-culture of CAR T cells with Nalm-6 cells, which are CD19+ cells that are specifically recognized and activated by CD19 CAR T cells. The results showed that the expression of CD137 in the CD19 CAR group was 11.14%, the expression of CD137 in the 18.2-19 bispecific CAR group was 10.55%, and the expression in the 18.2 CAR group was not detectable. CD19 CAR and 18.2-CD19 bispecific CAR can be activated by Nalm-6, while 18.2 CAR failed to activate Nalm-6. In conclusion, it was demonstrated that 18.2-CD19 bispecific CAR T cells can specifically recognize the 18.2 antigen and the CD19 antigen. Since CD137 is a marker protein for the activation of T cells, the level of CD137 up-regulation of CAR T cells, after co-culturing with CAR T cells and substrate target cells, can be used to determine whether CAR T cells are activated.

Abnormal glycosylation is known to be common in many tumors, such as the abnormal glycosylation of MUC1 (tMUC1). A CAR binding tMUC1 may include a scFv based on the 5E5 antibody. Many tumors specifically express certain characteristic targets. More information of tumor markers and their corresponding cancer types are listed in Table 3. The examples include two scFvs joined by linker to form a tandem CAR (tanCAR) comprising the two scFvs.

TABLE 3

CAR T cells and substrate cells

| Numbering | Remarks |
|---|---|
| 6917 | CAR-5e528z |
| 6921 | CAR-ACPP-28Z |
| 2529 | TanCAR 28z ACPP + G4S + 5e5LH |
| 2530 | TanCAR 28z ACPP + G4S + 5e5HL |
| 2533 | TanCAR 28z 5e5 + G4S + ACPP LH |
| 2534 | TanCAR 28z 5e5 + G4S + ACPP HL |
| MCF-7 | Breast cancer cell lines with high expression of tnMUC1 |
| PC3-ACPP | Human prostate cancer cells that overexpress ACPP |
| 2407 | tMUC1CAR-41bb |
| 163 | CLDN 18.2CAR |
| 2517 | TanCAR 5E5 LH + G4S + 163LH |
| 1604 | TSHR - 4-1BB |
| 2407 | t MUC1 - 4-1BB |
| 2519 | TSHR - G4S - tMUC1 - 4-1BB |
| 2521 | tMUC1 - G4S - TSHR - 4-1BB |

On Day 0, peripheral blood was drawn from healthy volunteers. CD3+ T cells were sorted with pan T kit and activated by CD3/CD28 Dynabeads at a ratio of 3:1. On Day 1, the activated CD3+ T cells were infected. Several groups of cells (each 1.00E+06 T cells) were infected with Vectors based on the Table 4, and remaining cells were used as NT (non-transfected). On Day 2, the lentivirus and the Dynabeads were removed, and the culture media were replaced. On Day 6, the CAR ratio and cell phenotype of CAR T cells were measured in each group using flow cytometry assay. Since anti-ACPP antibodies are a humanized antibody and anti-MUC1 antibodies are a murine antibody, a rabbit anti-human CAR antibody and rabbit anti-mouse CAR antibody were used to detect expression of these two scFvs, respectively. On Day 7, the experiment was carried out according to Table 4. The samples were flow-stained after 24 hours of full activation. The supernatant was collected for detection of Cytometric Bead Array (CBA), and carboxyfluorescein succinimidyl ester (CFSE) staining was performed to observe the proliferation. The cells were co-cultured with fluorescent substrate cells, and the survival of cells with fluorescent substrates was observed to determine the killing effect.

TABLE 4 cells for co-culturing assay

| ID | Vectors | SEQ ID | MOI | Number of cells | hCAR+ (ACPP) | mCAR+ (tMUC1) | Co-culture |
|---|---|---|---|---|---|---|---|
| 6917 | CAR-5e528z | | 13.15 | 1.00E+06 | | 62.2 | Co-cultured with substrate cells (MCF-7, PC3-ACPP, 293T) |
| 6921 | CAR-ACPP-28z | | 23.05 | 1.00E+06 | 61.18 | | |
| 2529 | TanCAR 28z ACPP + G4S + 5e5LH | | 51.65 | 1.00E+06 | 55.21 | 49.54 | |
| 2530 | TanCAR 28z ACPP + G4S + 5e5HL | | 52.49 | 1.00E+06 | 70.51 | 60.49 | |
| 2533 | TanCAR 28z 5e5 + G4S + ACPP LH | | 51.04 | 1.00E+06 | 55.94 | 63.1 | |
| 2534 | TanCAR 28z 5e5 + G4S + ACPP HL | | 52.28 | 1.00E+06 | 34.21 | 31.47 | |
| 2407 | tMUC1CAR-41bb | | 8.44 | 1.00E+06 | | 25.68 | Co-cultured with substrate cells (MCF-7, KATO3+, 293T) |
| 163 | CLDN 18.2CAR | | 64.8 | 1.00E+06 | | 41.06 | |
| 2517 | TanCAR 5E5 LH + G4S + 163LH | | 59.7 | 1.00E+06 | | 44.42 | |

Figure 66:
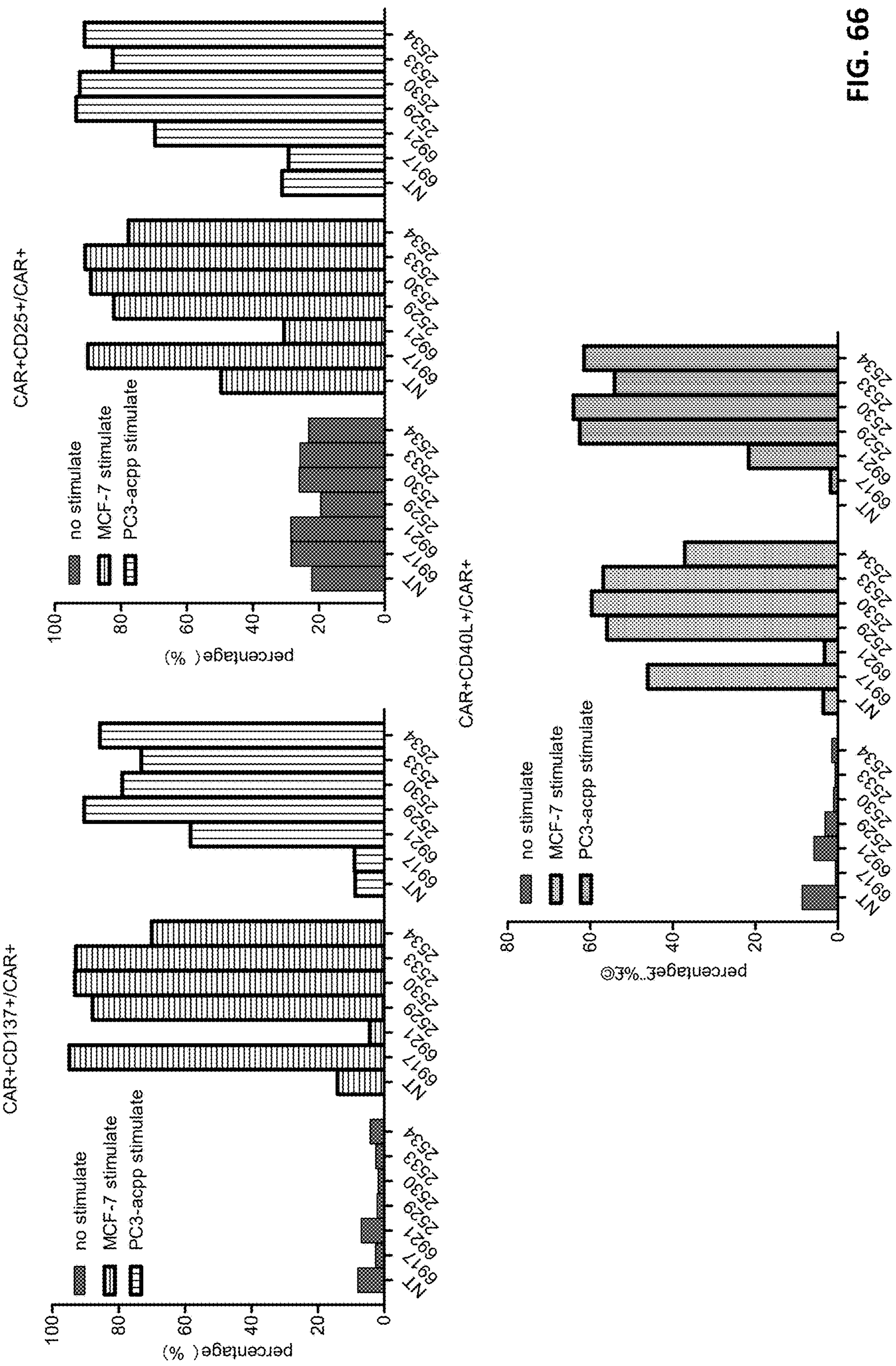
FIG. 66 shows expression of several markers on CAR T cells and TanCAR T cells using flow cytometry analysis.

FIG. 66 provides histograms showing expression of several markers on CAR T cells and tanCAR T cells using flow cytometry assay. NT, 6917, 6921, 2529, 2530, 2533, as well as 2534 and substrate cells (MCF-7, PC3-acpp, 293T cells) were co-cultured for 24 hours and flow cytometry assay was performed on Day 8. CAR T cells and three substrate cells (293T, MCF-7, PC3-acpp) were co-cultured for 24 hrs. Flow cytometry assay was performed after the activation of CAR T cells. In FIG. 66, the vertical coordinates are CAR+ CD137+ cells (the total CAR+ cells) and CAR+CD25+ (total CAR+ cells), respectively. From the expression of CD137 and CD25, four types of tanCAR cells were effectively activated by corresponding substrate cells. The statistical analysis of the expression of CD40L by flow cytometry was performed after CAR T cells was co-cultured with substrate cells (293T, MCF-7 and PC3-acpp) for 24 h. Four types of tanCAR cells expressed CD40L, which can activate CD40+ and other immune cells of the immune system, such as B cells, activated monocytes, DCs, etc.

Figure 67:
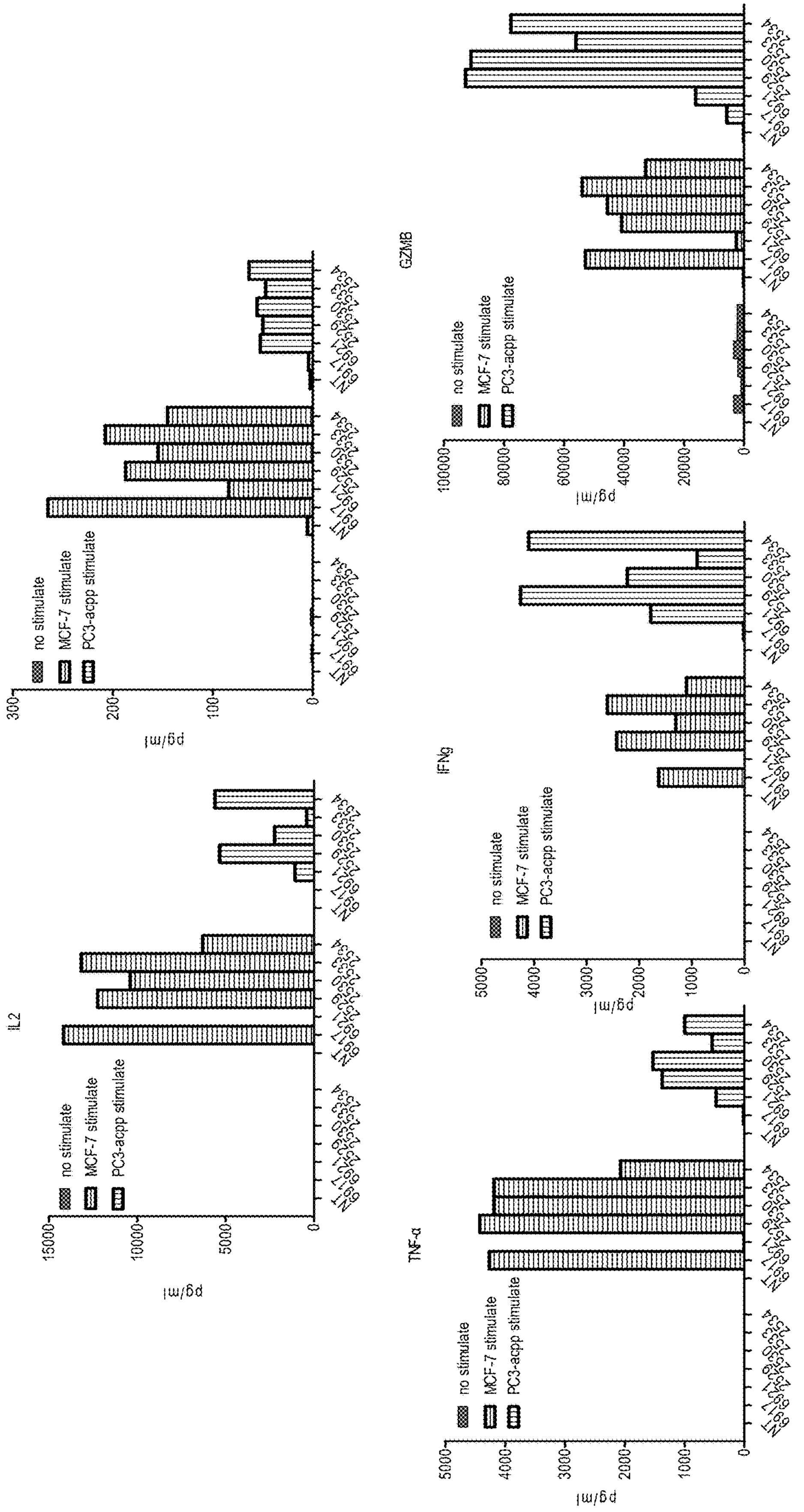
FIG. 67 shows cytokine release of CAR T cells and TanCAR T cells.

FIG. 67 provides histograms showing cytokine release of CAR T cells and tanCAR T cells. NT, 6917, 6921, 6921, 2529, 2530, 2533, as well as 2534 and substrate cells (MCF-7, PC3-acpp, 293T cells), were co-cultured for 24 hours and cytokine release was measured on Day 8.

Figure 68:
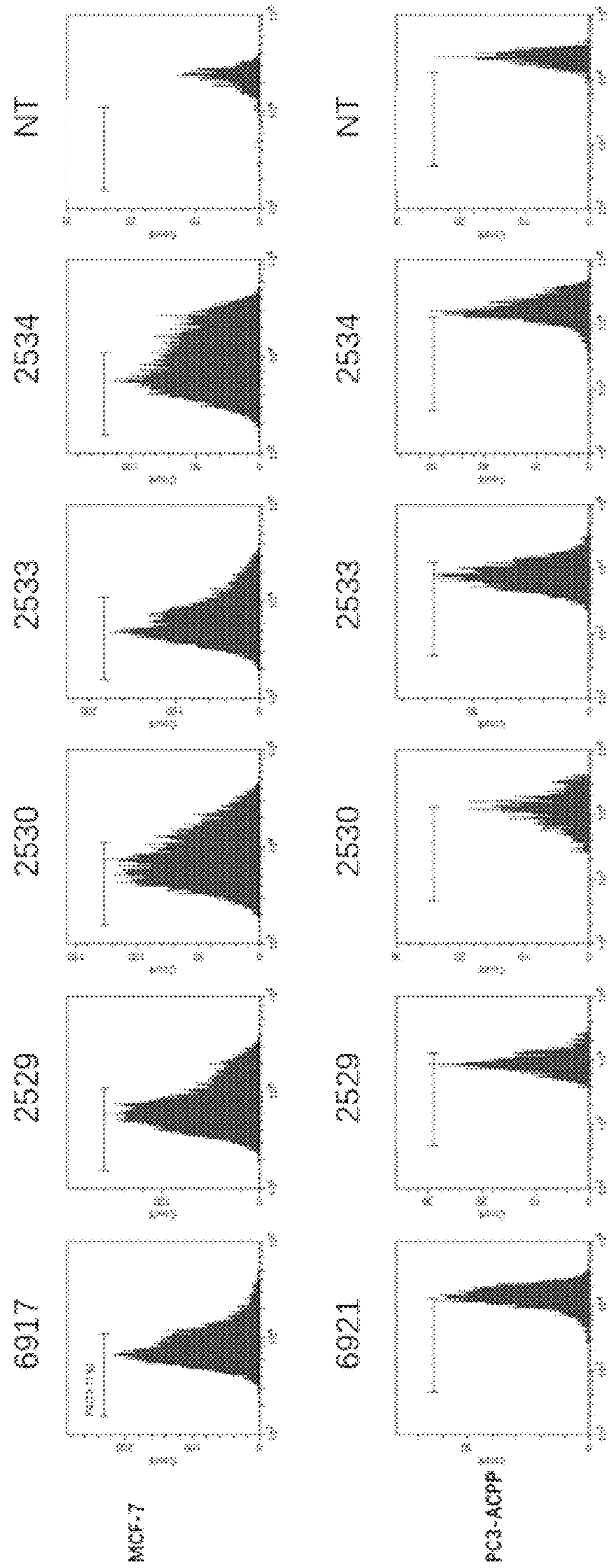
FIG. 68 shows the expansion of cells in each group after 5 days of stimulation with the corresponding substrate cells.

FIG. 68 shows the expansion of cells in each group after 5 days of stimulation with the corresponding substrate cells. As compared to control groups, tanCAR groups showed apparent expansion in response to both substrate cells. Proliferation of 6917, 6921, 2529, 2530, 2533, 2534, and NT was measured on Day 12 after co-culturing with substrate cells (MCF-7, PC3-acpp, 293T cells) for 5 days.

Figure 69:
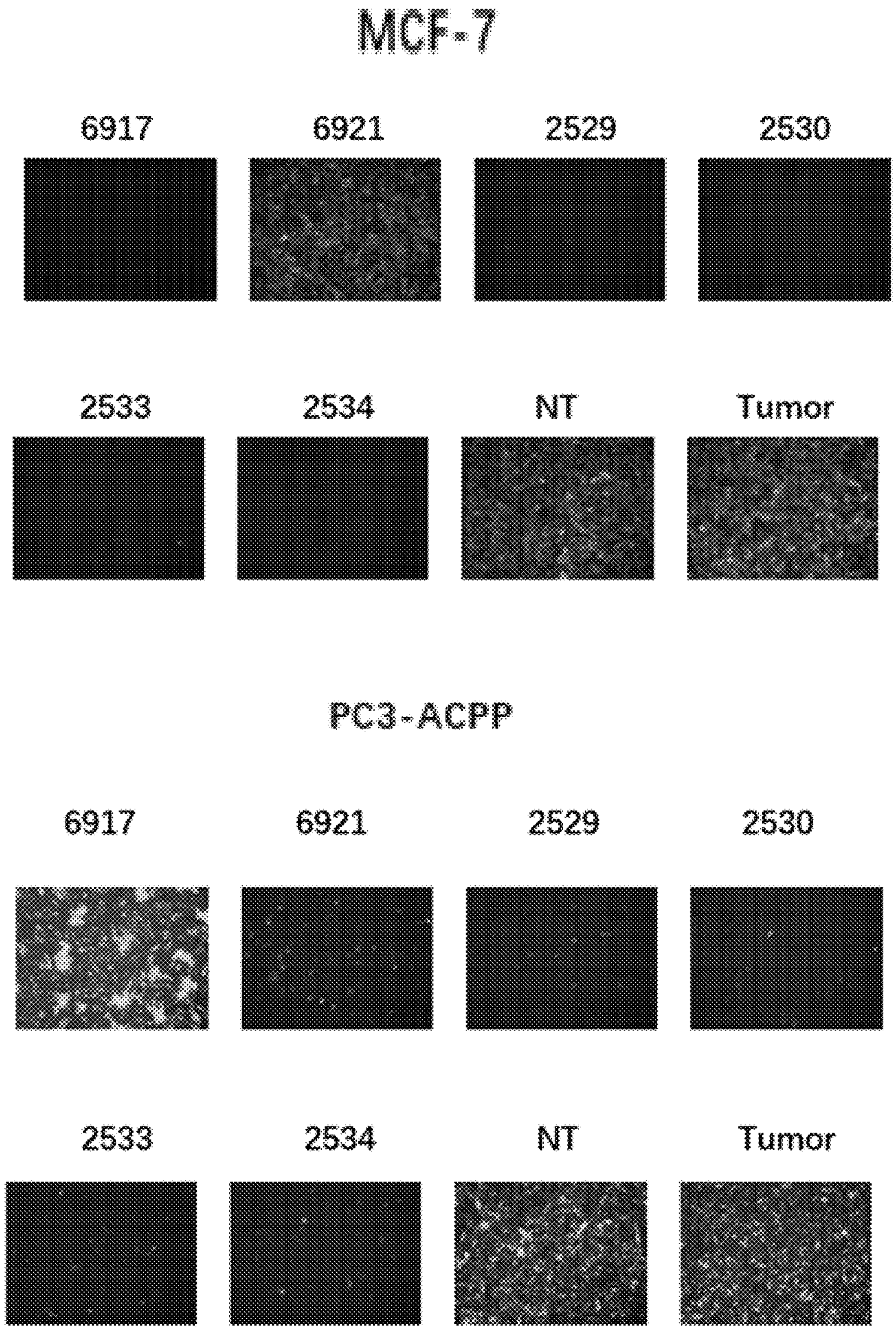
FIG. 69 shows results of killing assay indicating that 6917 inhibited MCF-7 and 6921 inhibited PC3-ACPP.

FIG. 69 shows killing assay results. The results indicate that 6917 inhibited MCF-7 and 6921 inhibited PC3-ACPP. The four groups of tanCAR T cells killed both substrate cells. NT was negative for the experiment. The control contained only tumor cells. Killing assay was performed for 6917, 6921, 2529, 2530, 2533, 2534 and NT cells after co-culturing with substrate cells for five days.

Figure 70:
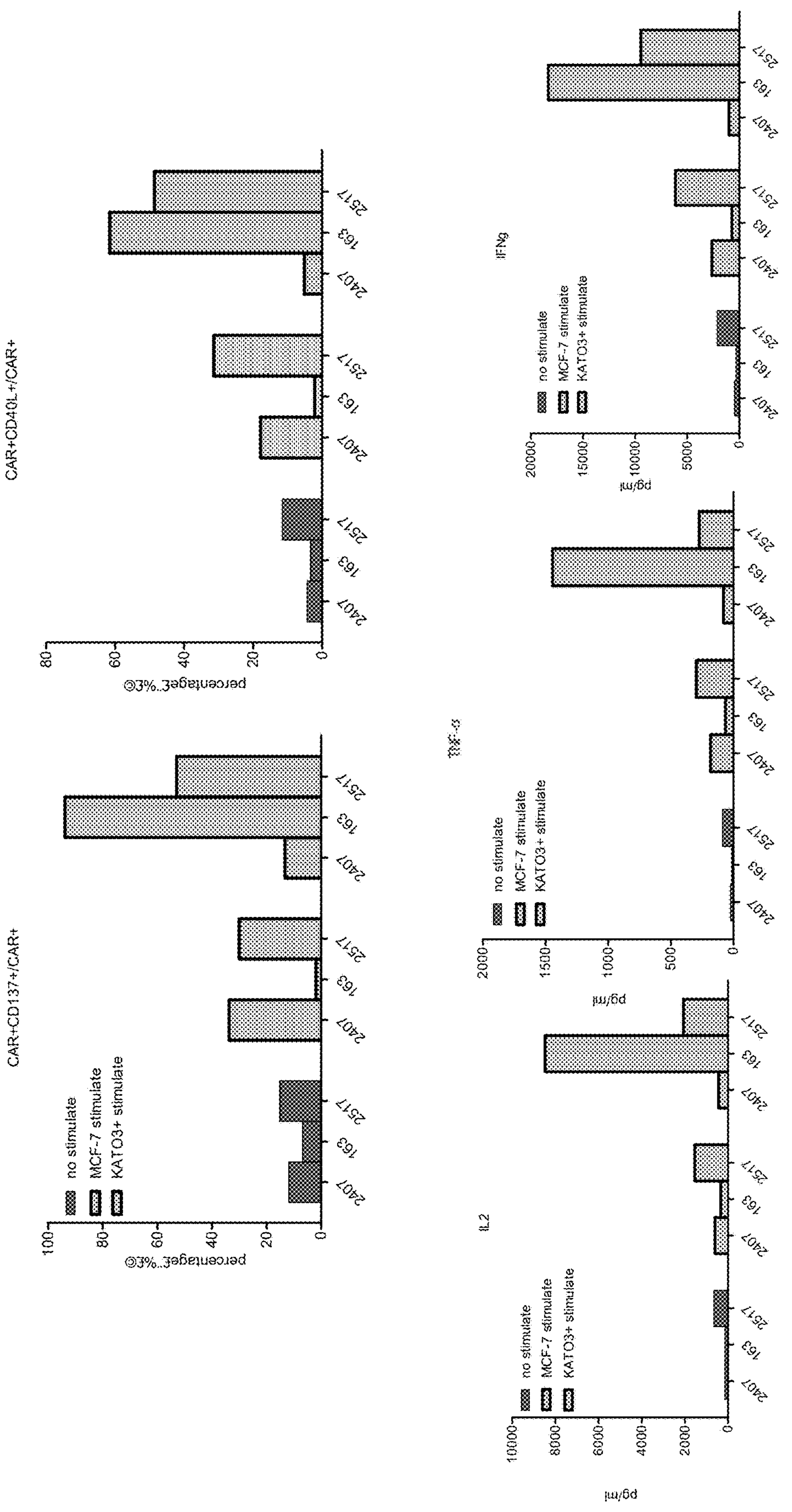
FIG. 70 shows expression of several markers on CAR T cells and TanCAR T cells and the cytokine release of CAR T cells and TanCAR T cells measured using flow cytometry analysis.

FIG. 70 provides histograms showing expression of several markers on other CAR T cells and tanCAR T cells and cytokine release using flow cytometry assay. 2407, 163, and 2517 were co-cultured with MCF-7, KATO3+, and 293T cells for 24 hours on Day 8, and cytokine release assay were performed. TanCAR 2517 were activated by both MCF-7 and KATO3+ substrate cells, and the intensity and proportion were close to single CAR. The corresponding CAR T cells were co-cultured with substrate cells (293T, MCF-7, and KATO3+) for 24 hrs, and the expression of CD40L was detected by flow cytometry.

Figure 71:
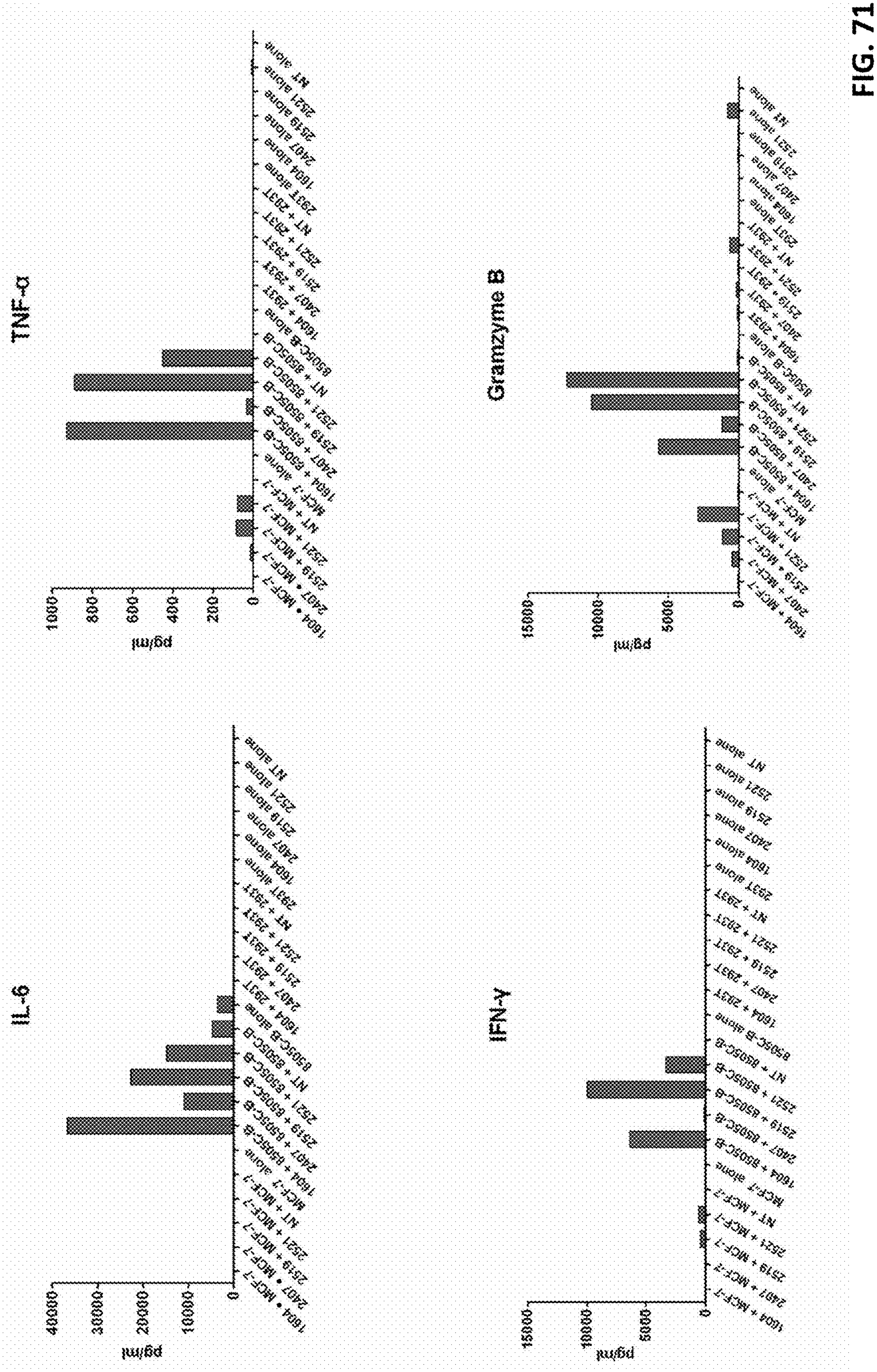
FIG. 71 shows cytokine release of various CAR T cells and TanCAR T cells in response to substrate cells.

FIG. 71 cytokine release of various CAR T cells and tanCAR T cells in response to substrate cells. The experimental process and experimental design were similar to those of experiments above.

TABLE 5

Sequence IDs and corresponding identifiers

| Name | SEQ ID NO: | Name | SEQ ID NO: | Name | SEQ ID No: |
|---|---|---|---|---|---|
| SP | 1 | UPK2 | 101 | Construct of MUC1-5E5-A-IRES-CD19-A | 201 |
| Hinge & transmembrane domain | 2 | ADAM12 | 102 | CAR 1 of MUC1-5E5-A-IRES-CD19-A | 202 |
| Co-stimulatory domain | 3 | SLC45A3 | 103 | CAR 2 of MUC1-5E5-A-IRES-CD19-A | 203 |
| CD3-zeta | 4 | ACPP | 104 | Construct of MUC1-5E5-B-IRES-CD19-A | 204 |
| scFv Humanized CD19 | 5 | MUC21 | 105 | CAR 1 of MUC1-5E5-B-IRES-CD19-A | 205 |
| scFv CD19 | 6 | MUC16 | 106 | CAR 2 of MUC1-5E5-B-IRES-CD19-A | 203 |
| scFv FZD10 | 7 | MS4A12 | 107 | Construct of MUC1-5E5-A-IRES-CD19-B | 206 |
| scFv TSHR | 8 | ALPP | 108 | CAR 1 of MUC1-5E5-A-IRES-CD19-B | 202 |
| scFv PRLR | 9 | SLC2A14 | 109 | CAR 2 of MUC1-5E5-A-IRES-CD19-B | 207 |
| scFv Muc 17 | 10 | GS1-259H13.2 | 110 | Construct of MUC1-5E5-B-IRES-CD19-B | 208 |
| scFv GUCY2C | 11 | ERVFRD-1 | 111 | CAR 1 of MUC1-5E5-B-IRES-CD19-B | 205 |
| scFv CD207 | 12 | ADGRG2 | 112 | CAR 2 of MUC1-5E5-B-IRES-CD19-B | 207 |
| Prolactin (ligand) | 13 | ECEL1 | 113 | Construct of MUC1-2-A-IRES-CD19-A | 209 |
| scFv CD3 | 14 | CHRNA2 | 114 | CAR 1 of MUC1-2-A-IRES-CD19-A | 210 |
| scFv CD4 | 15 | GP2 | 115 | CAR 2 of MUC1-2-A-IRES-CD19-A | 203 |
| scFv CD4-2 | 16 | PSG9 | 116 | Construct of MUC1-2-B-IRES-CD19-A | 211 |

TABLE 5-continued

Sequence IDs and corresponding identifiers

| Name | SEQ ID NO: | Name | SEQ ID NO: | Name | SEQ ID No: |
|---|---|---|---|---|---|
| scFv CD5 | 17 | SIGLEC15 | 117 | CAR 1 of MUC1-2-B-IRES-CD19-A | 212 |
| CD19 antigen | 18 | SLC6A3 | 118 | CAR 2 of MUC1-2-B-IRES-CD19-A | 203 |
| FZD10 antigen | 19 | KISS1R | 119 | Construct of MUC1-2-A-IRES-CD19-B | 213 |
| TSHR antigen | 20 | QRFPR | 120 | CAR 1 of MUC1-2-A-IRES-CD19-B | 210 |
| PRLR antigen | 21 | GPR119 | 121 | CAR 2 of MUC1-2-A-IRES-CD19-B | 207 |
| Muc 17 antigen | 22 | CLDN6 | 122 | Construct of MUC1-2-B-IRES-CD19-B | 214 |
| GUCY2C antigen | 23 | SP-2 | 123 | CAR 1 of MUC1-2-B-IRES-CD19-B | 212 |
| CD207 antigen | 24 | Linker-2 | 124 | CAR 2 of MUC1-2-B-IRES-CD19-B | 207 |
| CD3 antigen | 25 | Hinge-2 | 125 | Construct of MUC1-5E5-A-IRES-hCD19-A | 215 |
| CD4 antigen | 26 | TM-2 | 126 | CAR 1 of MUC1-5E5-A-IRES-hCD19-A | 202 |
| CD5 antigen | 27 | 4-1BB-2 | 127 | CAR 2 of MUC1-5E5-A-IRES-hCD19-A | 216 |
| CAR CD19 nucleic acid | 28 | CD3 zeta-2 | 128 | Construct of MUC1-5E5-B-IRES-hCD19-A | 217 |
| Hinge & TM domain B | 29 | CLDN6-CAR-1 | 129 | CAR 1 of MUC1-5E5-B-IRES-hCD19-A | 205 |
| Hinge & TM domain A | 30 | ScFv CLDN6-CAR-1 | 130 | CAR 2 of MUC1-5E5-B-IRES-hCD19-A | 216 |
| Hinge & TM domain D | 31 | ScFv VL CLDN6-CAR-1 | 131 | Construct of MUC1-5E5-A-IRES-hCD19-B | 218 |
| Hinge & TM domain C | 32 | ScFv VH CLDN6-CAR-1 | 132 | CAR 1 of MUC1-5E5-A-IRES-hCD19-B | 202 |
| Hinge domain D | 33 | CLDN6-CAR-2 | 133 | CAR 2 of MUC1-5E5-A-IRES-hCD19-B | 219 |
| Hinge domain C | 34 | ScFv CLDN6-CAR-2 | 134 | Construct of MUC1-5E5-B-IRES-hCD19-B | 220 |
| Hinge domain B | 35 | ScFv VL CLDN6-CAR-2 | 135 | CAR 1 of MUC1-5E5-B-IRES-hCD19-B | 205 |
| Hinge domain A | 36 | ScFv VH CLDN6-CAR-2 | 136 | CAR 2 of MUC1-5E5-B-IRES-hCD19-B | 219 |

TABLE 5-continued

Sequence IDs and corresponding identifiers

| Name | SEQ ID NO: | Name | SEQ ID NO: | Name | SEQ ID No: |
|---|---|---|---|---|---|
| TM domain D | 37 | CLDN6-CAR-3 | 137 | Construct of MUC1-2-A-IRES-hCD19-A | 221 |
| TM domain A | 38 | scFv CLDN6-CAR-3 | 138 | CAR 1 of MUC1-2-A-IRES-hCD19-A | 210 |
| CD19 extracellular domain | 39 | scFv VL CLDN6-CAR-3 | 139 | CAR 2 of MUC1-2-A-IRES-hCD19-A | 216 |
| TM domain C or B | 40 | scFv VH CLDN6-CAR-3 | 140 | Construct of MUC1-2-B-IRES-hCD19-A | 222 |
| WTCD3zeta | 41 | CLDN6-CAR-4 | 141 | CAR 2CAR 1 of MUC1-2-B-IRES-hCD19-A | 212 |
| WTCD3zeta-BCMACAR full length | 42 | scFv CLDN6-CAR-4 | 142 | Construct of MUC1-2-B-IRES-hCD19-A | 216 |
| BCMA | 43 | scFv VL CLDN6-CAR-4 | 143 | Construct of MUC1-2-A-IRES-hCD19-B | 223 |
| BCMA CAR vector | 44 | scFv VH CLDN6-CAR-4 | 144 | CAR 1 of MUC1-2-A-IRES-hCD19-B | 210 |
| BCMA CAR vector | 45 | SIGLEC-15-CAR-1 | 145 | CAR 2 of MUC1-2-A-IRES-hCD19-B | 219 |
| VL anti-CD5 | 46 | scFv SIGLEC-15-CAR-1 | 146 | Construct of MUC1-2-B-IRES-hCD19-B | 224 |
| VH anti-CD5 | 47 | scFv VL SIGLEC-15-CAR-1 | 147 | CAR 1 of MUC1-2-B-IRES-hCD19-B | 212 |
| VL anti-CD4 | 48 | scFv VH SIGLEC-15-CAR-1 | 148 | CAR 2 of MUC1-2-B-IRES-hCD19-B | 219 |
| VH anti-CD4 | 49 | VL1 VH1 SIGLEC-15-CAR-2 | 149 | Construct of MUC1-5E5-A-IRES-CD22-A | 225 |
| VL anti-CD3 | 50 | VL1 VH2 SIGLEC-15-CAR-3 | 150 | CAR 1 of MUC1-5E5-A-IRES-CD22-A | 202 |
| VH anti-CD3 | 51 | VL1 VH3 SIGLEC-15-CAR-4 | 151 | CAR 2 of MUC1-5E5-A-IRES-CD22-A | 226 |
| TSHR extracellular domain | 52 | VL1 VH 4 SIGLEC-15-CAR-5 | 52 | Construct of MUC1-5E5-B-IRES-CD22-A | 227 |
| VH region of BCMA scFv | 53 | VL2 VH 1 SIGLEC-15-CAR-6 | 153 | CAR 1 of MUC1-5E5-A-IRES-CD22-A | 205 |
| VL region of BCMA scFv | 54 | VL2 VH2 SIGLEC-15-CAR-7 | 154 | CAR 2 of MUC1-5E5-A-IRES-CD22-A | 226 |
| VH region of CD14 scFv | 55 | VL2 VH3 SIGLEC-15-CAR-8 | 155 | Construct of MUC1-5E5-A-IRES-CD22-B | 228 |
| VL region of CD14 scFv | 56 | VL2 VH4 SIGLEC-15-CAR-9 | 156 | MUC1-5E5-A-IRES-CD22-B CAR 1 | 202 |

TABLE 5-continued

Sequence IDs and corresponding identifiers

| Name | SEQ ID NO: | Name | SEQ ID NO: | Name | SEQ ID No: |
|---|---|---|---|---|---|
| VH region of CD33 scFv | 57 | VL1 SIGLEC-15-CAR | 157 | MUC1-5E5-A-IRES-CD22-B CAR 2 | 229 |
| VL region of CD33 scFv | 58 | VL2 SIGLEC-15-CAR | 158 | MUC1-5E5-B-IRES-CD22-B | 230 |
| CD22CAR | 59 | VH1 SIGLEC-15-CAR | 159 | CAR 1 of MUC1-5E5-B-IRES-CD22-B | 205 |
| BCMACAR | 60 | VH2 SIGLEC-15-CAR | 160 | CAR 2 of MUC1-5E5-B-IRES-CD22-B | 229 |
| MUC1CAR | 61 | VH3 SIGLEC-15-CAR | 161 | Construct of MUC1-2-A-IRES-CD22-A | 231 |
| m19CAR-IRES-MUC1CAR | 62 | VH4 SIGLEC-15-CAR | 162 | CAR 1 of MUC1-2-A-IRES-CD22-A | 210 |
| hCD19CAR-IRES-MUC1CAR | 63 | MUC16-CAR-1 | 163 | CAR 2 of MUC1-2-A-IRES-CD22-A | 226 |
| hCD22CAR-IRES-MUC1CAR | 64 | scFv MUC16-CAR-1 | 164 | MUC1-2-B-IRES-CD22-A | 232 |
| BCMACAR-IRES-MUC1CAR | 65 | scFv VL MUC16-CAR-1 | 165 | MUC1-2-B-IRES-CD22-A CAR 1 | 212 |
| mCD19CAR-2A-MUC1CAR | 66 | scFv VH MUC16-CAR-1 | 166 | MUC1-2-B-IRES-CD22-A CAR 2 | 226 |
| hCD19CAR-2A-MUC1CAR | 67 | MUC16-CAR-2 | 167 | MUC1-2-A-IRES-CD22-B | 233 |
| hCD22CAR-2A-MUC1CAR | 68 | scFv MUC16-CAR-2 | 168 | MUC1-2-A-IRES-CD22-B CAR 1 | 210 |
| BCMA-2A-MUC1CAR | 69 | scFv VL MUC16-CAR-2 | 169 | MUC1-2-A-IRES-CD22-B CAR 2 | 229 |
| Tumor associated MUC1 scFv 1 | 70 | scFv VH MUC16-CAR-2 | 170 | Construct of MUC1-2-B-IRES-CD22-B | 234 |
| Tumor associated MUC1 scFv-1 VH | 71 | KISS1R-CAR | 171 | CAR 1 of MUC1-2-B-IRES-CD22-B | 212 |
| Tumor associated MUC1 scFv-1 VL | 72 | Ligent peptide KISS1R-CAR | 172 | CAR 2 of MUC1-2-B-IRES-CD22-B | 229 |
| Tumor associated MUC1 scFv-1 VL CDR 1 | 73 | ZFLm1 (left) RS aa | 173 | Construct of MUC1-5E5-A-IRES-CD14-A | 235 |
| L2D8-2 (hCAR VL) | 74 | ZFLm1 (left) F1 | 174 | CAR 1 of MUC1-5E5-A-IRES-CD14-A | 202 |
| Tumor associated MUC1 scFv-1 VL CDR 3 | 75 | ZFLm1 (left) F2 | 174 | CAR 2 of MUC1-5E5-A-IRES-CD14-A | 236 |
| Tumor associated MUC1 scFv-1 VH CDR 1 | 76 | ZFLm1 (left) F3 | 176 | Construct of MUC1-5E5-B-IRES-CD14-A | 237 |
| Tumor associated MUC1 scFv-1 VH CDR 2 | 77 | ZFLm1 (left) F4 | 177 | CAR 1 of MUC1-5E5-B-IRES-CD14-A | 205 |

TABLE 5-continued

Sequence IDs and corresponding identifiers

| Name | SEQ ID NO: | Name | SEQ ID NO: | Name | SEQ ID No: |
|---|---|---|---|---|---|
| Tumor associated MUC1 scFv-1 VH CDR 3 | 78 | ZFLm1 (left) F5 | 178 | CAR 2 of MUC1-5E5-B-IRES-CD14-A | 236 |
| Tumor associated MUC1 scFv2 | 79 | ZFLm1 (left) F6 | 179 | Construct of MUC1-5E5-A-IRES-CD14-B | 238 |
| Tumor associated MUC1 scFv2 VH | 80 | ZFRm1-4 (right) RS aa | 180 | CAR 1 of MUC1-5E5-A-IRES-CD14-B | 202 |
| Tumor associated MUC1 scFv2 VL | 81 | ZFRm1-4 (right) F1 | 181 | CAR 2 of MUC1-5E5-A-IRES-CD14-B | 239 |
| Tumor associated MUC1 scFv-2 VL CDR 1 | 82 | ZFRm1-4 (right) F2 | 182 | Construct of MUC1-2-A-IRES-CD14-A | 240 |
| Tumor associated MUC1 scFv-2 VL CDR 2 | 83 | ZFRm1-4 (right) F3 | 184 | CAR 1 of MUC1-2-A-IRES-CD14-A | 210 |
| Tumor associated MUC1 scFv-2 VL CDR 3 | 84 | ZFRm1-4 (right) F4 | 184 | CAR 2 of MUC1-2-A-IRES-CD14-A | 236 |
| 'Tumor associated MUC1 scFv-2VH CDR 1 | 85 | δ chain-1 of Vγ9Vδ2 | 185 | Construct of MUC1-2-B-IRES-CD14-A | 241 |
| Tumor associated MUC1 scFv-2 VH CDR 2 | 86 | γ chain-2 of Vγ9Vδ2 | 186 | CAR 1 of MUC1-2-B-IRES-CD14-A | 212 |
| Tumor associated MUC1 scFv-2 VH CDR 3 | 87 | δ chain-2 of Vγ9Vδ2 | 187 | CAR 2 of MUC1-2-B-IRES-CD14-A | 236 |
| GSTA motif | 88 | Vγ9Vδ2 TCR-1: DG. SF13 δ chain | 188 | Construct of MUC1-2-A-IRES-CD14-B | 242 |
| Modified PD-1 intracellular domain -1 | 89 | Vγ9Vδ2 TCR-1: DG. SF13 δ chain | 189 | CAR 1 of MUC1-2-A-IRES-CD14-B | 210 |
| Modified PD-1 intracellular domain -2 | 90 | Vγ9Vδ2 TCR-2: DG. SF68: γ chain | 190 | CAR 2 of MUC1-2-A-IRES-CD14-B | 239 |
| Modified PD-1 intracellular domain -3 | 91 | Vγ9Vδ2 TCR-2: DG. SF68: δ chain | 191 | Construct of MUC1-2-B-IRES-CD14-B | 243 |
| Modified PD-1 intracellular domain -4 | 92 | Vγ9Vδ2 TCR-3: 12G12: γ chain | 192 | CAR 1 of MUC1-2-B-IRES-CD14-B | 212 |
| Modified PD-1 intracellular domain -5 | 93 | Vγ9Vδ2 TCR-3: 12G12: δ chain | 193 | CAR 2 of MUC1-2-B-IRES-CD14-B | 239 |
| Removed PD-1 intracellular domain -1 | 94 | Vγ9Vδ2 TCR-4: CP.1.15 γ chain | 194 | Construct of MUC1-5E5-A-IRES-BCMA-A | 244 |
| Removed PD-1 intracellular domain -2 | 95 | TCR-4: CP.1.15δ chain | 195 | CAR 1 of MUC1-5E5-A-IRES-BCMA-A | 202 |

TABLE 5-continued

Sequence IDs and corresponding identifiers

| Name | SEQ ID NO: | Name | SEQ ID NO: | Name | SEQ ID No: |
|---|---|---|---|---|---|
| Fokl WC | 96 | WT CD3-zeta | 196 | CAR 2 of MUC1-5E5-A-IRES-BCMA-A | 245 |
| M Fokl | 97 | Invariant sequence for iNKT α chain (hVα24-JαQ-TRAC) | 197 | Construct of MUC1-5E5-B-IRES-BCMA-A | 246 |
| M Fokl | 98 | An example for iNKT β chain sequence (containing Vβ11): | 198 | CAR 1 of MUC1-5E5-B-IRES-BCMA-A | 205 |
| γ chain-1 of Vγ9Vδ2 | 99 | Invariant sequence for MAIT α chain (hAV7S2-AJ33 α chain) (version1) | 199 | CAR 2 of MUC1-5E5-B-IRES-BCMA-A | 245 |
| VL anti-CD4-2 | 100 | VH anti- CD4-2 | 200 | Construct of MUC1-5E5-A-IRES-BCMA-B | 247 |
| CAR 1 of MUC1-2-A-IRES-CD33-A | 210 | CAR 1 of MUC1-5E5-B-IRES-CD33-A | 205 | CAR 1 of MUC1-5E5-A-IRES-BCMA-B | 202 |
| CAR 2 of MUC1-2-A-IRES-CD33-A | 255 | CAR 2 of MUC1-5E5-B-IRES-CD33-A | 255 | CAR 2 of MUC1-5E5-A-IRES-BCMA-B | 248 |
| Construct ofMUC1-2-B-IRES-CD33-A | 261 | Construct ofMUC1-5E5-A-IRES-CD33-B | 257 | Construct of MUC1-5E5-B-IRES-BCMA-B | 249 |
| CAR 1 of MUC1-2-B-IRES-CD33-A | 212 | CAR 1 of MUC1-5E5-A-IRES-CD33-B | 202 | CAR 1 of MUC1-5E5-B-IRES-BCMA-B | 205 |
| CAR 2 of MUC1-2-B-IRES-CD33-A | 255 | CAR 2 of MUC1-5E5-A-IRES-CD33-B | 258 | CAR 2 of MUC1-5E5-B-IRES-BCMA-B | 245 |
| Construct ofMUC1-2-A-IRES-CD33-B | 262 | Construct ofMUC1-5E5-B-IRES-CD33-B | 259 | Construct of MUC1-2-A-IRES-BCMA-A | 250 |
| CAR 1 of MUC1-2-A-IRES-CD33-B | 210 | CAR 1 of MUC1-5E5-B-IRES-CD33-B | 205 | CAR 1 of MUC1-2-A-IRES-BCMA-A | 210 |
| CAR 2 of MUC1-2-A-IRES-CD33-B | 258 | CAR 2 of MUC1-5E5-B-IRES-CD33-B | 258 | CAR 2 of MUC1-2-A-IRES-BCMA-A | 245 |
| Construct ofMUC1-2-B-IRES-CD33-B | 263 | Construct ofMUC1-2-A-IRES-CD33-A | 260 | Construct of MUC1-2-B-IRES-BCMA-A | 251 |
| CAR 1 of MUC1-2-B-IRES-CD33-B | 212 | Construct ofMUC1-2-B-IRES-BCMA-B | 253 | CAR 1 of MUC1-2-B-IRES-BCMA-A | 212 |
| CAR 2 of MUC1-2-B-IRES-CD33-B | 258 | CAR 1 of MUC1-2-B-IRES-BCMA-B | 212 | CAR 2 of MUC1-2-B-IRES-BCMA-A | 245 |
| Construct ofMUC1-5E5-A-IRES-CD33-A | 254 | MUC1-2-B-IRES-BCMA-B CAR 2 | 248 | Construct of MUC1-2-A-IRES-BCMA-B | 252 |
| CAR 1 of MUC1-5E5-A-IRES-CD33-A | 202 | MUC1-5E5-B-IRES-CD33-A | 256 | CAR 1 of MUC1-2-A-IRES-BCMA-B | 210 |

TABLE 5-continued

| Sequence IDs and corresponding identifiers | | | | | |
|---|---|---|---|---|---|
| Name | SEQ ID NO: | Name | SEQ ID NO: | Name | SEQ ID No: |
| CAR 2 of MUC1-5E5-A-IRES-CD33-A | 255 | CAR 2 of MUC1-2-A-IRES-BCMA-B | 248 | Mcu1-5e5Panko-enhanced scFc | 264 |
| Mcu1-Panko5e5-enhanced scFc | 265 | hinge and/or transmembrane domain A | 266 | hinge and/or transmembrane domain B | 267 |
| hinge and/or transmembrane domain C | 268 | hinge and/or transmembrane domain D | 269 | Mcu1-5e5Panko-enhanced scFc A 41BB CD2 zeta | 270 |
| Mcu1-5e5Panko-enhanced scFc B 41BB CD2 zeta | 271 | Mcu1-5e5Panko-enhanced scFc C 41BB CD2 zeta | 272 | Mcu1-5e5Panko-enhanced scFc D 41BB CD2 zeta | 273 |
| Mcu1-Panko5e5-enhanced scFc A 41BB CD2 zeta | 274 | Mcu1-Panko5e5-enhanced scFc B 41BB CD2 zeta | 275 | Mcu1-Panko5e5-enhanced scFc C 41BB CD2 zeta | 276 |
| Mcu1-Panko5e5-enhanced scFc D 41BB CD2 zeta | 277 | GS linker | 278 | Construct of TSHR CAR | 279 |
| M Fokl-1 | 280 | M Fokl-2 | 281 | Fokl WC | 282 |
| PSCA-CAR ScFv | 356 | CD8sp | 428 | Anti-TSHR-VL | 429 |
| 3*GGGGS linker | 278 | Anti-TSHR-VH | 430 | 4*GGGGS bispecific CAR linker | 431 |
| humanized-anti CD19-VH | 432 | humanized-anti CD19-VL | 433 | B7-H3 scFv 1 | 434 |
| B7-H3 scFv 2 | 435 | B7-H3 scFv 3 | 436 | Anti- CLDN 18.2 (175) -VL | 437 |
| Anti- CLDN 18.2 (175) -VH | 438 | CLDN 18.2 (175) CAR Binding domain | 439 | | |
| tMUC1-CLDN 18.2 tanCAR binding domain 175/5e5LH | 440 | tMUC1-CLDN 18.2 tanCAR 5e5/175LH-1 | 452 | scfv TSHR LH | 466 |
| tMUC1-CLDN 18.2 tanCAR binding domain 175/5e5HL | 441 | tMUC1-CLDN 18.2 tanCAR 5e5/175HL-1 | 453 | scfv TSHR HL | 467 |
| tMUC1-CLDN 18.2 tanCAR binding domain 163/5e5LH | 442 | tMUC1-CLDN 18.2 tanCAR 5e5/163LH-1 | 454 | scfv GUCY2C LH | 468 |
| tMUC1-CLDN 18.2 tanCAR binding domain 163/5e5HL | 443 | tMUC1-CLDN 18.2 tanCAR 5e5/163HL-1 | 455 | scfv GUCY2C HL | 469 |
| tMUC1-CLDN 18.2 tanCAR binding domain 5e5/175LH | 444 | tMUC1-CLDN 18.2 tanCAR 175/5e5LH-2 | 456 | scfv ACPP LH | 470 |

TABLE 5-continued

| Sequence IDs and corresponding identifiers | | | | | |
|---|---|---|---|---|---|
| Name | SEQ ID NO: | Name | SEQ ID NO: | Name | SEQ ID No: |
| tMUC1-CLDN 18.2 tanCAR binding domain 5e5/175HL | 445 | tMUC1-CLDN 18.2 tanCAR 175/5e5HL-2 | 457 | scfv ACPP HL | 471 |
| tMUC1-CLDN 18.2 tanCAR binding domain 5e5/163LH | 446 | tMUC1-CLDN 18.2 tanCAR 163/5e5LH-2 | 458 | scfv UPK2 LH (1) | 472 |
| tMUC1-CLDN 18.2 tanCAR binding domain 5e5/163HL | 447 | tMUC1-CLDN 18.2 tanCAR 163/5e5HL-2 | 459 | scfv UPK2 HL (1) | 473 |
| tMUC1-CLDN 18.2 tanCAR 175/5e5LH-1 | 448 | tMUC1-CLDN 18.2 tanCAR 5e5/175LH-2 | 460 | scfv UPK2 LH (2) | 474 |
| tMUC1-CLDN 18.2 tanCAR 175/5e5HL-1 | 449 | tMUC1-CLDN 18.2 tanCAR 5e5/175HL-2 | 461 | scfv UPK2 HL (2) | 475 |
| tMUC1-CLDN 18.2 tanCAR 163/5e5LH-1 | 450 | tMUC1-CLDN 18.2 tanCAR 5e5/163LH-2 | 462 | scfv PSMA LH | 476 |
| tMUC1-CLDN 18.2 tanCAR 163/5e5HL-1 | 451 | tMUC1-CLDN 18.2 tanCAR 5e5/163HL-2 | 463 | scfv PSMA HL | 477 |
| scfv CD19 HL | 465 | scfv CD19 LH | 464 | anti CXCR5 Scfv | 478 |
| Anti DPEP3 Scfv | 479 | hCD19-CAR (4-1BB + CD3 zeta)-NATF-IL6-2A-IFNγ | 480 | NFAT6x + minimal IL12 promoter | 481 |
| IL-6 aa Sequence | 482 | 2A | 483 | IFN-γ aa | 484 |
| hCD19-CAR (4-1BB + CD3 zeta)-NATF-IL12-VHL | 485 | IL12 aa | 486 | Hif VHL-interaction domain: Hif amino acid 344-417 | 487 |
| GUCY2C-CAR | 488 | scFy 6503 S5D1 | 489 | 163: cldn18.2 scfv: CD8-signal peptide + cldn18.2VL + GS linker + cldn18.2VH | 490 |
| 6921: ACPP scFv: CD8-signal peptide + acpp-VL + GS linker + acpp-VH | 491 | 2517: tMUC1, cldn18.2 tanCAR | 492 | 2519: tMUC1, cldn18.2 tanCAR | 493 |
| 2521: TSHR, tMUC1 tanCAR | 494 | 2529: ACPP, tMUC1 tanCAR | 495 | 2530: ACPP, tMUC1 tanCAR | 496 |
| 2533: ACPP, tMUC1 tanCAR | 497 | 2534: ACPP, tMUC1 tanCAR | 498 | scFv target PSMA | 499 |

TABLE 5-continued

| Sequence IDs and corresponding identifiers | | | | | |
|---|---|---|---|---|---|
| Name | SEQ ID NO: | Name | SEQ ID NO: | Name | SEQ ID No: |
| scFy target Mesothelin | 500 | scFy target EGFRvIII | 501 | scFv target CEA | 502 |
| scFV target Glypican-3 | 503 | scFv target IL-13 | 504 | | |

GGGGS (SEQ ID NO: 278)

3*GGGGS is $(GGGGS)_3$ (SEQ ID NO: 124) and 4*GGGGS is $(GGGGS)_4$ (SEQ ID NO: 431)

CD8sp-- tMUC1-VL--3*GGGGS linker-- tMUC1-VH--4*GGGGS bispecific CAR linker-- humanized-CD19-VH--3*GGGGS linker--humanized-CD19-VL (2501)

CD8sp-- tMUC1-VL--3*GGGGS linker-- tMUC1-VH--4*GGGGS bispecific CAR linker-- humanized-CD19-VL--3*GGGGS linker-- humanized- CD19-VH (2504)

CD8sp-- humanized- CD19-VL--3*GGGGS linker-- humanized- CD19-VH --4*GGGGS bispecific CAR linker-- tMUC1-VL--3*GGGGS linker-- tMUC1-VH CD8sp-- humanized-CD19-VL--3*GGGGS linker-- humanized- CD19-VH --4*GGGGS bispecific CAR linker-- tMUC1-VH--3*GGGGS linker-- tMUC1-VL

TABLE 6

| Example targets of TCR therapy | |
|---|---|
| TCL1 | B cell lymphoma |
| NY-ESO-1 | Urinary squamous cell carcinoma/melanoma |
| MAGA1/2/3 | Lung cancer/pancreatic cancer/gastric cancer/breast cancer |
| MAGE A3/A6/A10/A12 | Lung cancer/pancreatic cancer/gastric cancer/breast cancer |
| HPV-16 E6/E7 | Cervical cancer/head and neck cancer/anal cancer |
| WT-1 | MDS & AML |
| SSX2 | Hepatocellular carcinoma/melanoma/prostate cancer |
| KRAS | Multiple malignant tumors |
| Neoantigen | Multiple malignant tumors |
| LMP7 | Brain cancer/HIV infection/cervical cancer in situ, cutaneous basal cell carcinoma or squamous cell carcinoma, localized prostate cancer or ductal carcinoma in situ |
| AFP | In theory, CART's maker (film surface) is also possible (as long as TCR can recognize) |
| HA1 | Multiple malignant tumors |
| P53 | Multiple leukemia + lymphoma |
| GP100 | Multiple malignant tumors |
| LMP1, LMP2 and EBNA1 | Melanoma |
| MCPyV | EBV |
| CEA | Merkel cell cancer |
| LAGE-1A | Multiple malignant tumors |
| MART-1 | Urinary squamous cell carcinoma/melanoma |

Example 2. Car T Cell Expansion and Anti-Tumor Activity in Patients

Clinical studies were designed to assess the safety and efficacy of infusing autologous T cells modified to express several solid tumor markers specific CAR/4-1BB/CD3-3 into patients. On the first arm of the studies, patients received solid tumor marker-specific CAR T cells only. The solid tumor marker included TSHR and tMUC1. On the second arm, patients received CAR T cells directed to CD19 and a solid tumor antigen (e.g., TSHR, tMUC1, or GUCY2C). T cells of the patients were obtained, modified, and infused to the patients. T cell responses of patients from the first and second arms were measured and compared using the following protocols, which were approved by the hospitals where the trials were conducted. All patients were provided with written informed consent. Information regarding these patients are provide below in Table 9 (SD: stable disease; PD: progressive disease; PR: partial remission; CR: complete remission; NR: no response).

PBMCs were obtained from patients. Various lentiviral vectors were generated and then transfected to the T cells, which were further cultured for several days before the co-cultivation assay. More information can be found in Tables 7, 9, and 10 below. Techniques related to cell cultures, construction of cytotoxic T-lymphocyte assay can be found in "Control of large, established tumor xenografts with genetically retargeted human T cells containing CD28 and CD137 domains," PNAS, Mar. 3, 2009, vol. 106 no. 9, 3360-3365, which is incorporated herein by reference in its entirety.

Several methods were used to generate CAR T cells. For Patients 001-003, CD3+ cells were obtained from PBMCs and were cultured using X-vivo 15 media containing IL-2. For example, CD3+ T cells can be collected using antibody kits including CD14, CD15, CD16, CD19, CD34, CD36, CD56, CD123, and CD235a to remove undesired cells. The CD3+ T cells were activated using CD3/CD28 Dynabeads and then sampled as well counted before infection. The number of cells to be infected was obtained. The cell number of Group 1 was $6\times10^7$, and the cell number of Group 2 was $7\times10^7$. The number of corresponding carriers and the volume of the carrier were calculated according to the required carrier MOI (See Table 10). For Patients 004-010, PBMCs were cultured using TEXMACS culture media containing IL-2. CD4 and CD8 magnetic beads were used to sort and select T cells in the PBMCs. The appropriate starting culture amount was selected and Transact activator was used to activate T cells. MACS® GMP T Cell TransAct™ includes a colloidal polymeric nanomatrix covalently attached to humanized recombinant agonists against human CD3 and CD28. Due to the nanomatrix MACS GMP T Cell TransAct can be sterile filtered and excess reagent can be removed by centrifugation and following conventional supernatant replacement or simply by media wash. This reagent is suitable for use in automated culture systems, such as the CliniMACS Prodigy® Instrument. The number of corresponding carriers and the volume of the carrier were calculated according to the required carrier MOI (See Table 10). Specifically, for Patients 004-008 and 010, lentiviral vectors containing multiple vectors were mixed with the T cells for 24 hours. The T cells were further washed and cultured for 8 days before being transported to the hospital. For Patient 009, the T cells were divided into four groups, and each group of T cells was mixed with lentiviral vectors, for 24 hours, which contain one or more vectors (See Table 7), and these T cells were washed and cultured for 8 days. These four groups of transfected T cells were mixed and then transported to the hospital.

TABLE 7

| Group | Vector | MOI | Day 6 hCAR+/ CD3+ | Day 6 CD19 scFv+/ CD3+ | Total CAR copy number per ugDNA | Ratio to Total IL-6/ IFN-γ | Ratio to Total IL12 | Ratio to Total TSHR |
|---|---|---|---|---|---|---|---|---|
| 1 | 1 | 50 | 42.64% | 12.37% | 112238.97 | 8.27% | 0.21% | 91.52% |
| | 2 | 10 | | | | | | |
| | 3 | 1 | | | | | | |
| 2 | 1 | 50 | 59.28% | 33.32% | 118925.1 | 17.77% | 0.34% | 81.89% |
| | 2 | 10 | | | | | | |
| | 3 | 1 | | | | | | |
| 3 | 3 | 20 | 19.52% | 18.16% | 19408.75 | 0.00% | 100.00% | 0.00% |
| 4 | 3 | 20 | 26.70% | 26.59% | 17874.89 | 0.00% | 100.00% | 0.00% |

For fresh cells, after removing the magnetic beads, the transduced cells were centrifuged or replaced with a solution of 95% compound electrolyte and 5% human albumin, loaded into a return bag, and transported at 15-25° C. after sealing. Fresh preparations are returned directly. For cryopreserved cells, the media including 33.75% compound electrolyte solution, 33.75% dextran 40 glucose solution, 25% human blood albumin, and 7.5% dimethyl sulfoxide was used for cryopreservation. The cell suspension was loaded into a cryopreservation bag and then the bag was cooled to −90° C. and transferred to a gas phase liquid nitrogen tank for storage. The reconstitution of the frozen preparations was completed within 30 minutes after resuscitation of the frozen preparations. Peripheral blood mononuclear cells (PBMCs) were obtained from patients by leukapheresis for CAR T cell preparation, and the first day of CAR T infusion was set as study day 0.

Several patients were given a conditioning treatment for lymphodepletion for CAR T cell infusion. Fludarabine- and cyclophosphamide-based conditioning treatment varied according to the tumor burden in the bone marrow (BM) and peripheral blood (PB). Some patients were administered a long-acting G-CSF for 1-3 days after the conditioning treatment at a dose of about 6 mg each or 100 μg/kg of body weight to boost the patient's neutrophils which are critical to fight off infections. CAR T cells were transfused to the patients. Each day CAR T cells were transported to hospital, washed, counted, checked for viability and then prepared for administration to patients, who were then observed closely for at least 2 hours. Cytokine Release Syndrome (CRS) was graded according to a revised grading system (See Lee D W. et al, Blood 2014; 124:188-95). Other toxicities during and after therapy were assessed according to the National Institutes of Health Common Terminology Criteria for Adverse Events Version 4.0 (http://ctep.cancer.gov/). Therapy responses were assessed by flow cytometry and morphological analysis. When possible, patients were assessed by chimeric gene expression levels.

Bone Marrow (BM) and peripheral blood (PB) samples after CAR T cell infusion were collected in K2EDTA BD vacutainer tubes. The persistence of CD19 CAR T cells in PB and BM of patients was determined by FACS. Circulating CAR T cell numbers per μl were calculated on the basis of measured absolute CD3+ T lymphocyte counts. Simultaneously, CAR DNA copies were evaluated as another method of determining CAR T cell expansion and persistence. Genomic DNA was extracted using a QIAamp DNA Blood Mini Kit (Qiagen) from cryopreserved PB and BM. CAR DNA copies were assessed by quantitative real-time PCR as described in the supplementary materials. The levels of cytokines IFN-γ, TNF-α, IL-4, IL-6, IL-10, IL-17, etc. in serum and CSF were measured in a multiplex format according to the manufacturer's instructions.

Genomic DNA was extracted using a QIAamp DNA Blood Mini Kit (Qiagen) from cryopreserved peripheral blood and bone marrow. Quantitative PCR (qPCR) was performed in real-time in triplicates using the ABI 2×TaqMan Universal Master Mix with AmpErase UNG (Applied Biosystems) in a 7500 real-time PCR system (Applied Biosystems). Copy numbers per microgram of genomic DNA were calculated from a standard curve of 10-fold serial dilutions of purified CAR plasmid containing 102-108 copies/μL. Amplification of an internal control gene was used for normalization of DNA quantities. Primers/probes specific for the CAR transgene and an internal control gene were as previously described (see Gökbuget N. et al., Blood 2012; 120:2032-41 and O'Brien S. et al, J Clin Oncol 2013; 31:676-83).

Figure 16:
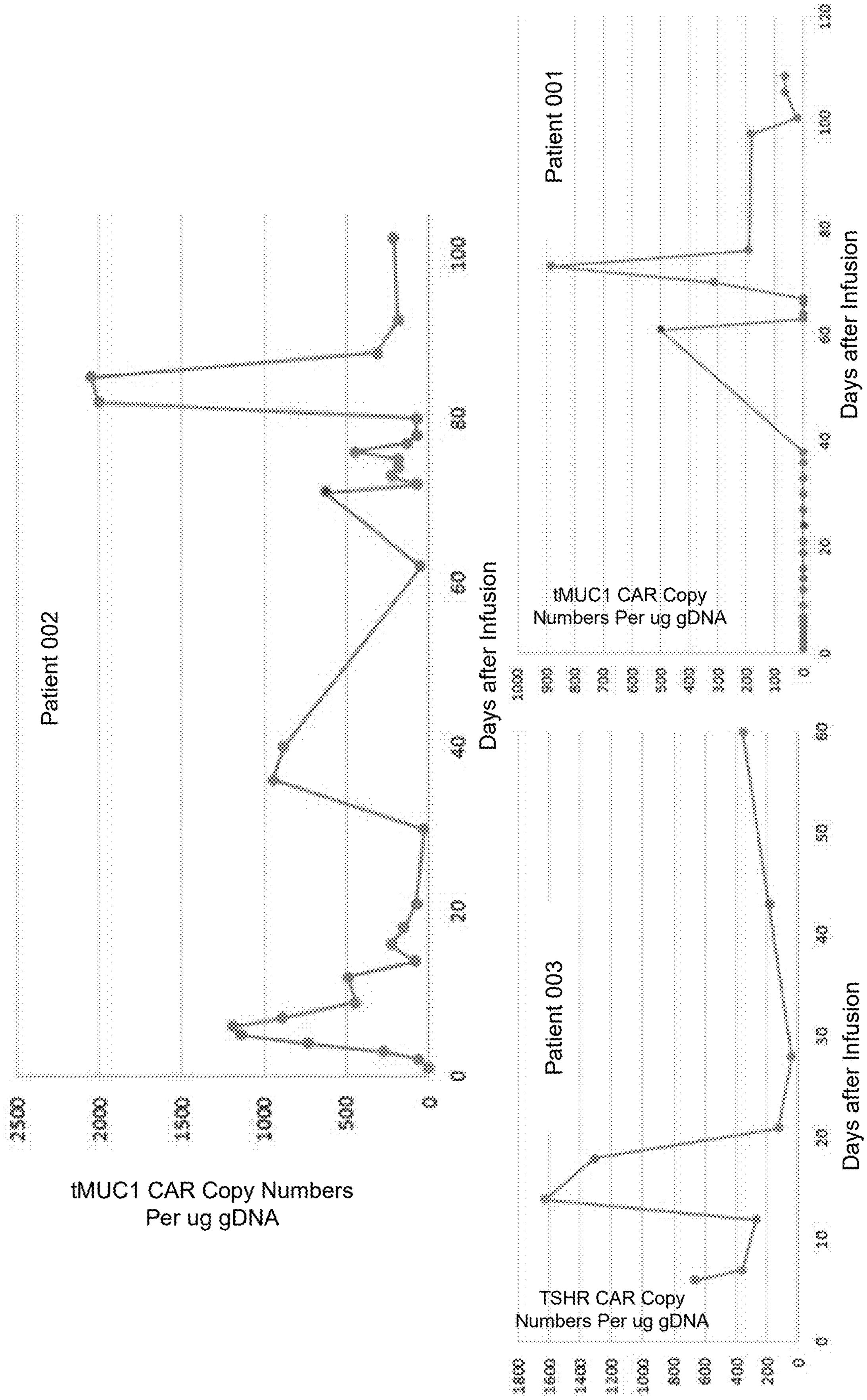
FIG. 16 shows changes in CAR copy number of patients with respect to days after infusion of T cells expressing a single CAR (tMUC1 CAR or TSHR CAR).
Figure 17:
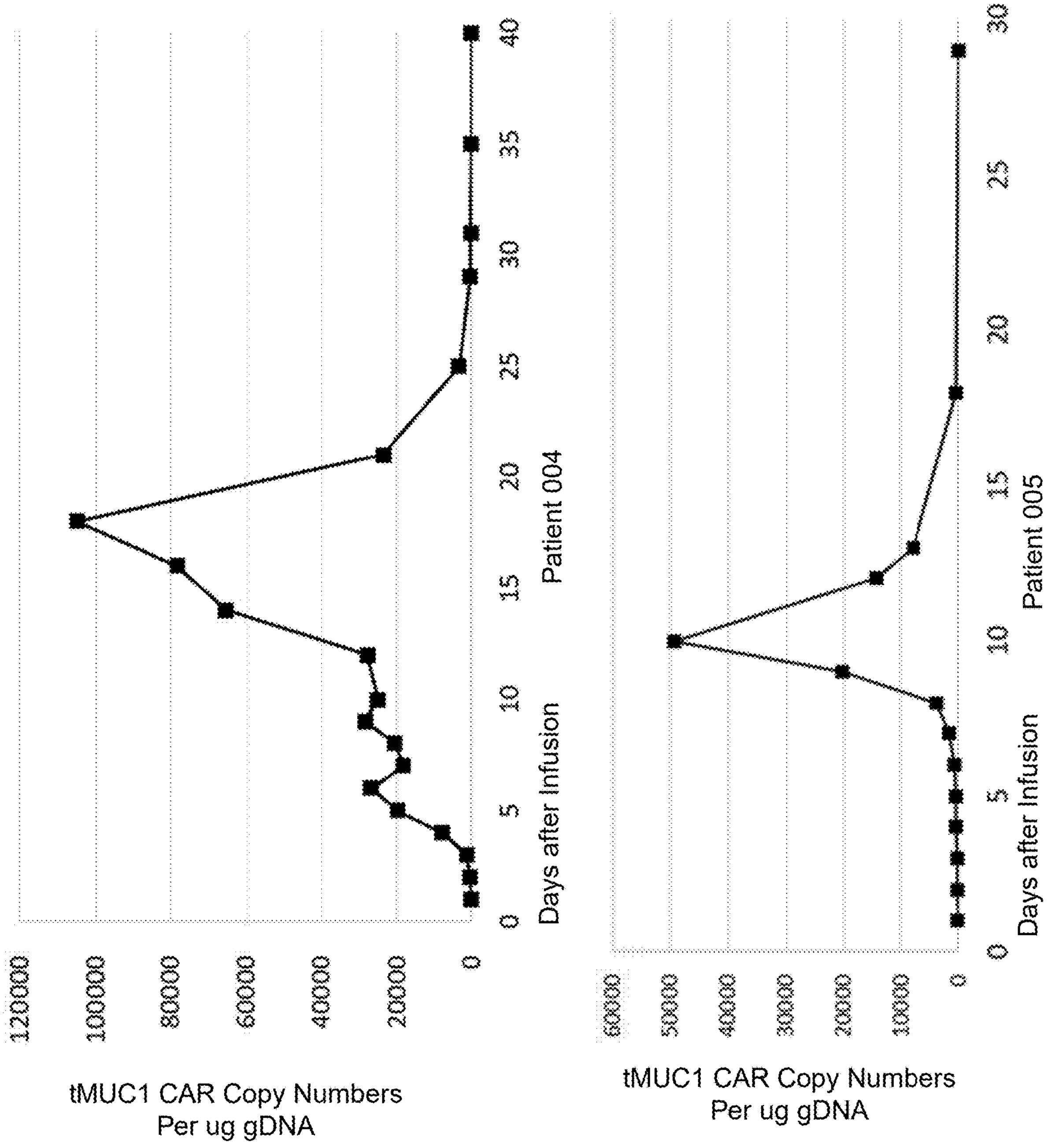
FIG. 17 shows changes in CAR copy number of patients with respect to days after infusion of T cells expressing tMUC1 CAR and CD19 CAR.

CAR T cell expansion was observed based on CAR copy numbers of individual CARs and shown in FIGS. 16 and 17. As shown in these figures, CAR T cells expansion in Patients 004 and 005 were significantly higher than those in Patients 002, 003, and 001, indicating that T cells expressing CD19 CAR and/or CD19 CAR and tMUC1 CAR enhanced CAR T cell expansion (Also see Table 10). T cells expressing CD19 CAR, solid tumor CAR (e.g., tMUC1, TSHR, GUCY2C CARs), and double CARs (CD19 CAR and solid tumor CAR) were calculated. For example, T cells expressing CD19 CAR, tMUC1 CAR, and double CARs (CD19 CAR and tMUC1 CAR) were calculated using the following equations:

WBC×CD3%×((tMUC1CAR+CD19CAR−)/CD3),

WBC×CD3%×(((MUC1CAR-CD19CAR+)/CD3), and

Figure 18:
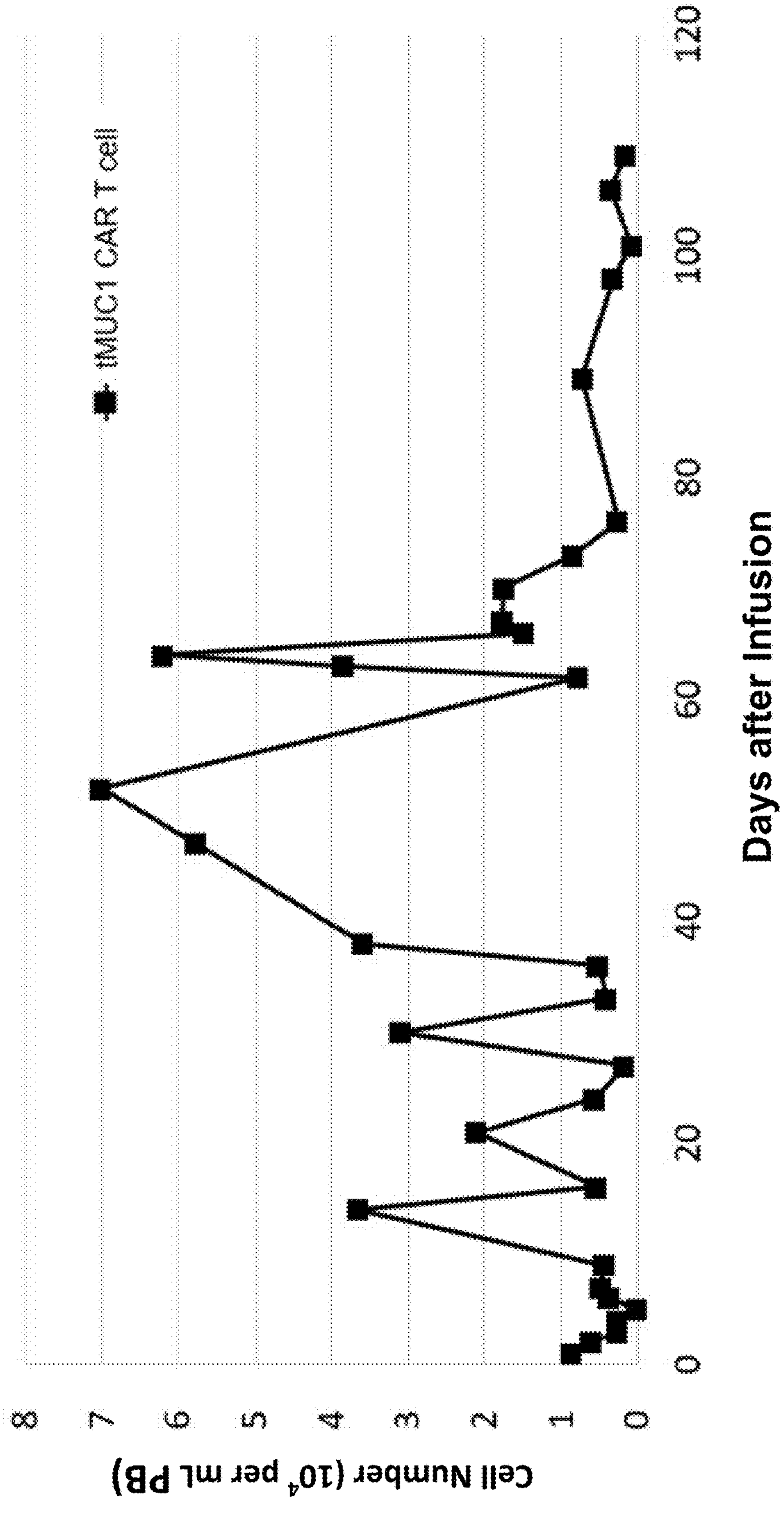
FIG. 18 shows changes in CAR T cell number of a patient with respect to days after infusion of T cells expressing tMUC1 CAR.
Figure 19:
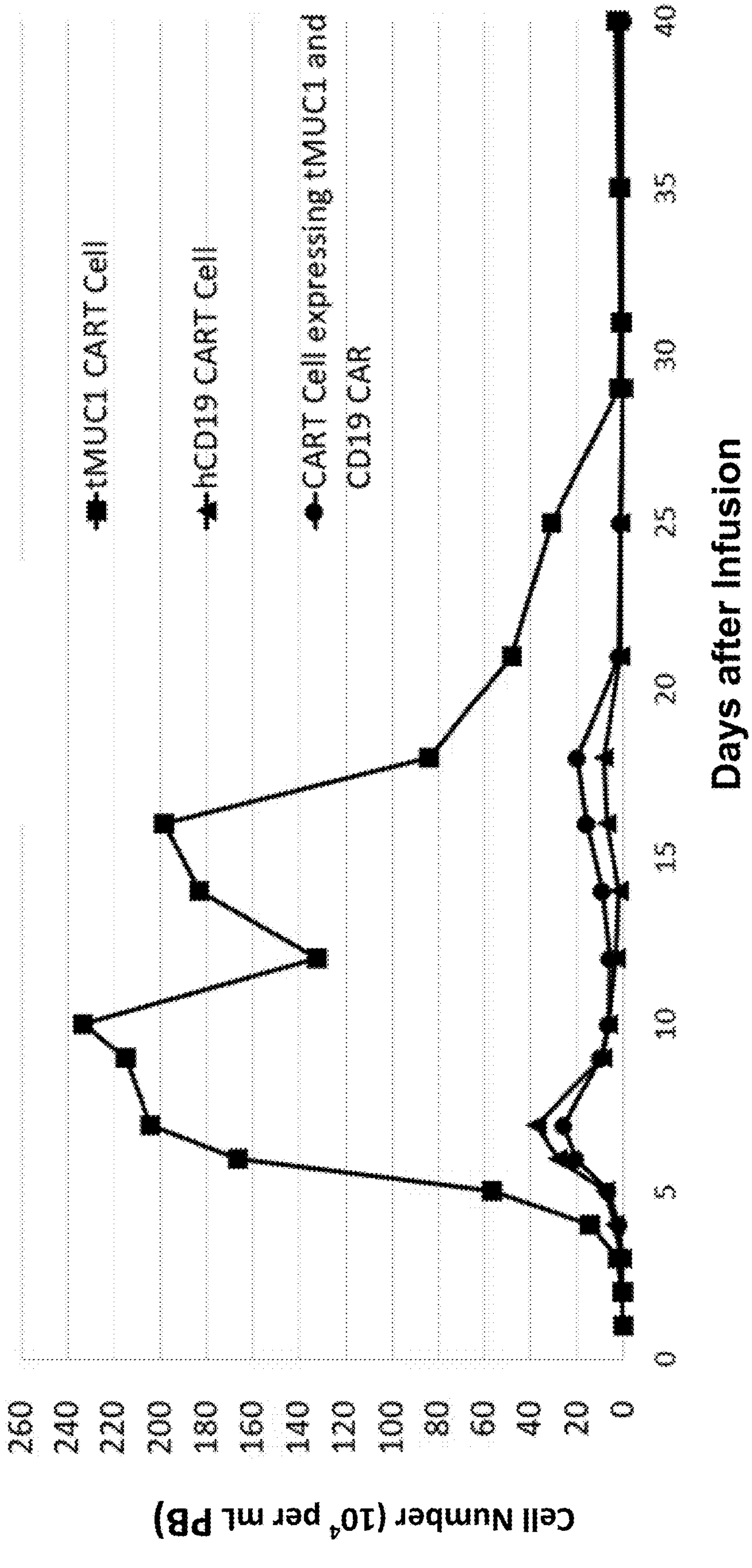
FIG. 19 shows changes in CAR T cell number of a patient with respect to days after infusion of mixed population of CAR T cells expressing tMUC1 CAR and CD19 CAR.
Figure 20:
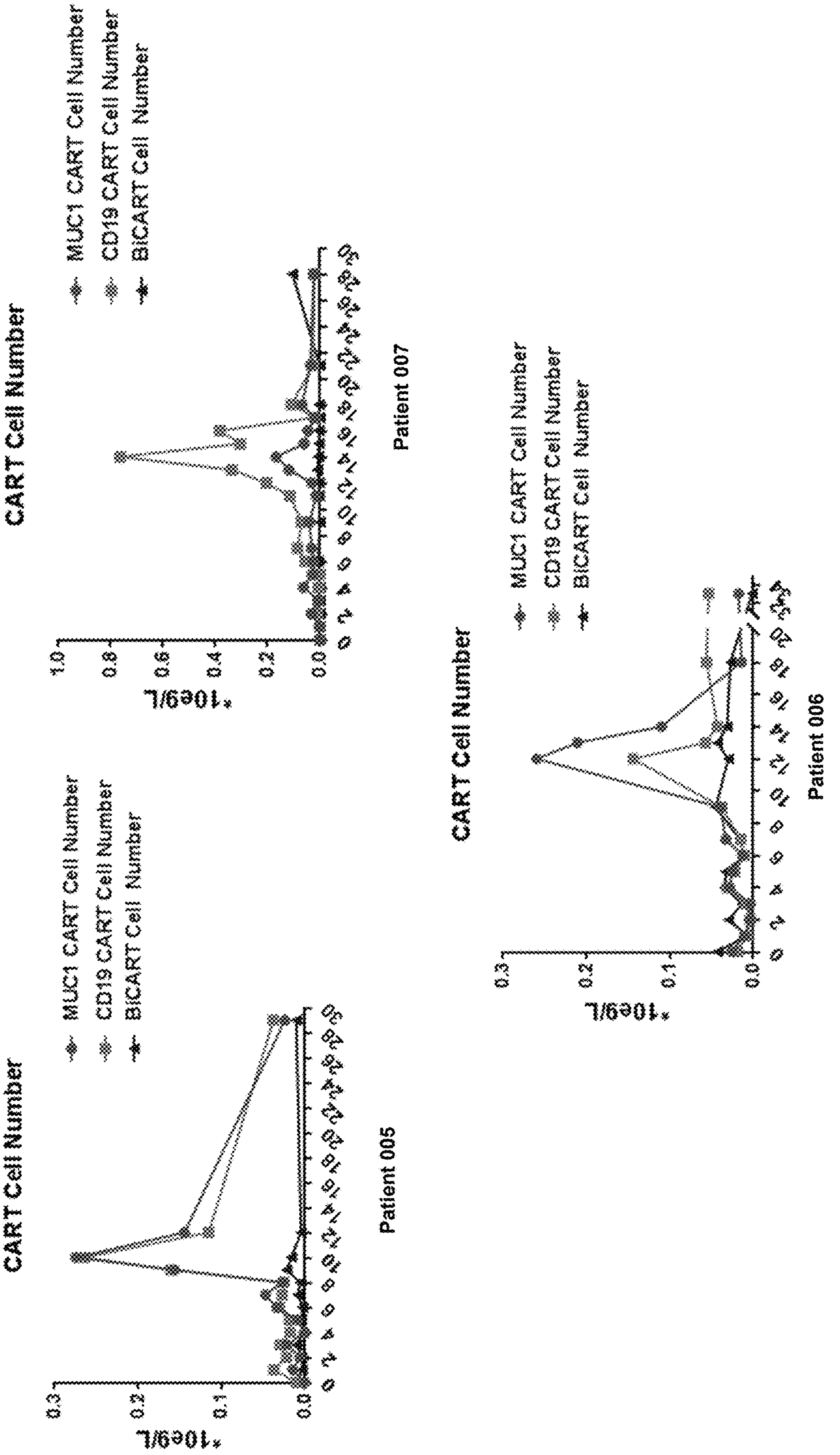
FIGS. 20 and 21 show changes in CAR T cell number of several patients with respect to days after infusion of mixed CAR T cells expressing MUC1 CAR and CD19 CAR.
Figure 21:
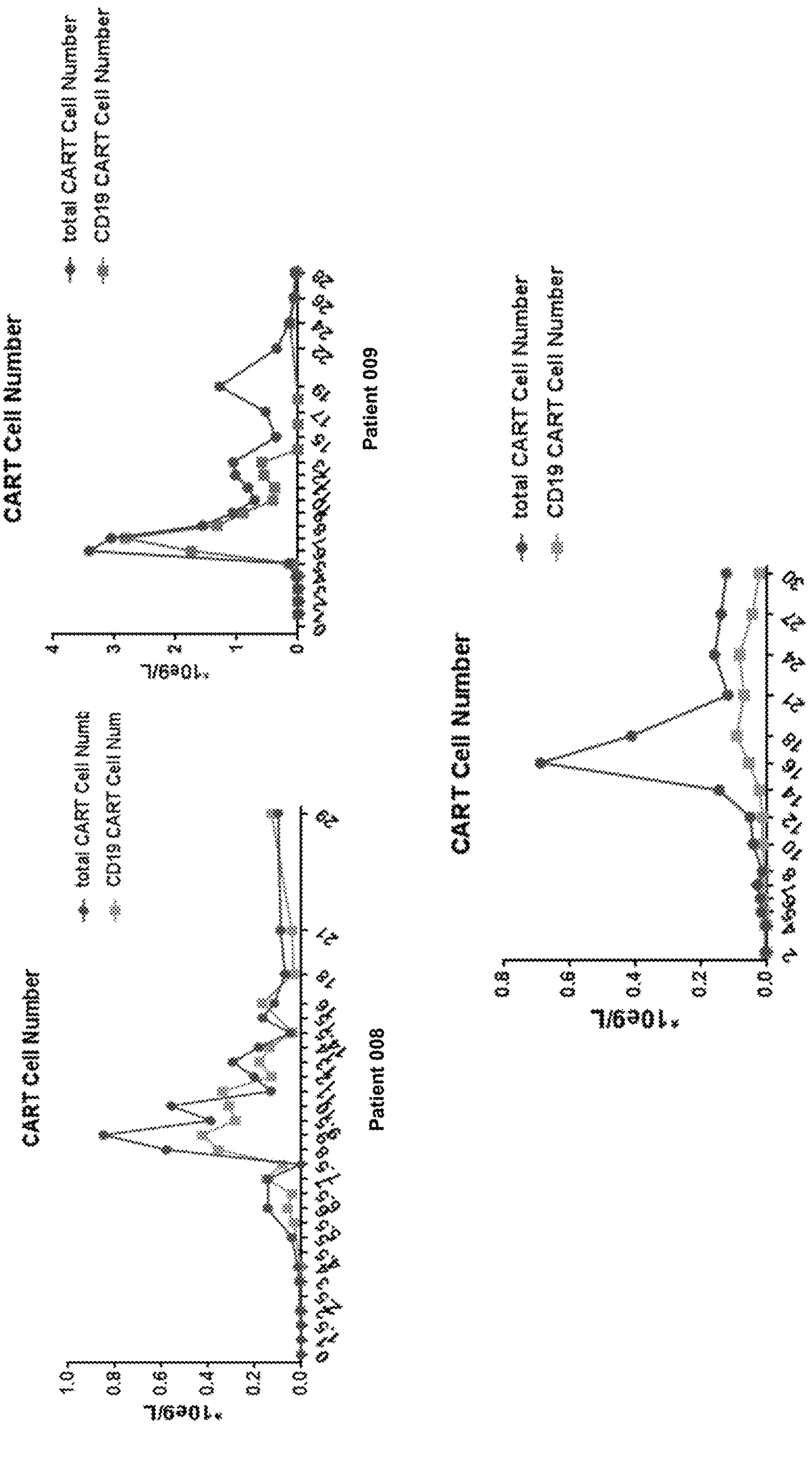
Figure 22:
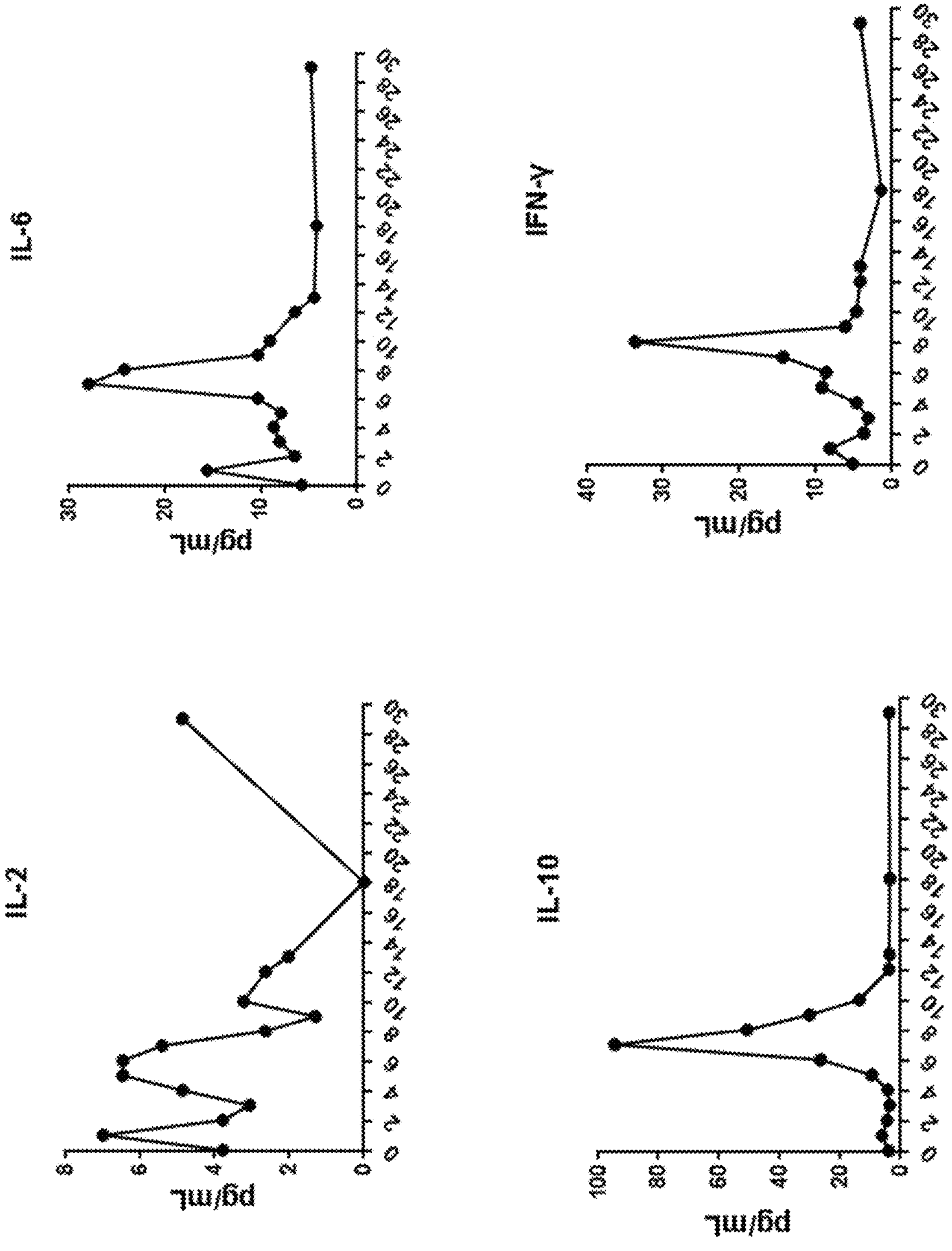
FIGS. 22, 23, 24, 25, 26, 27, 28, 29, 30, 31, and 32 show results of various assays for patients in response to infusion of mixed CAR T cells.
Figure 23:
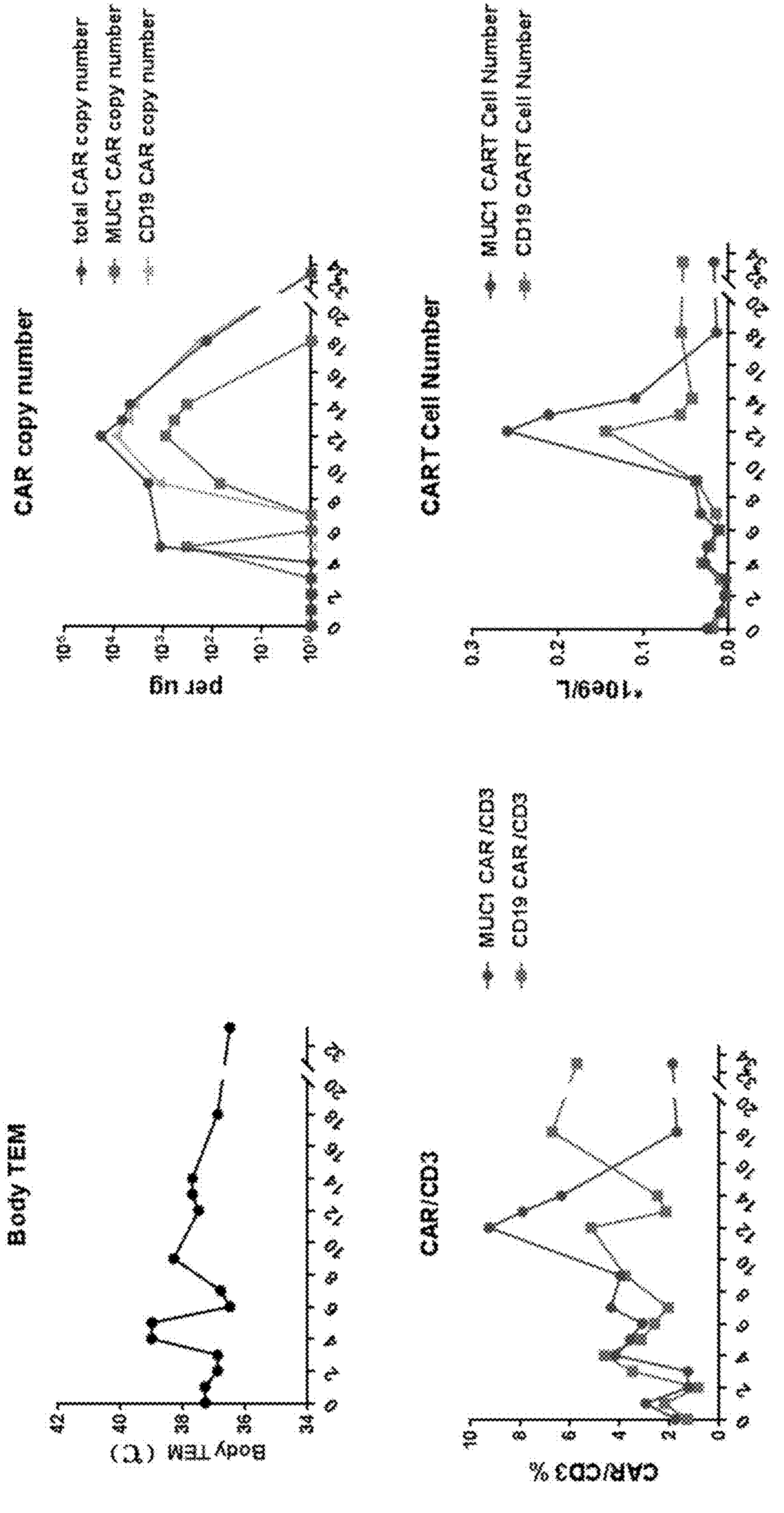
Figure 24:
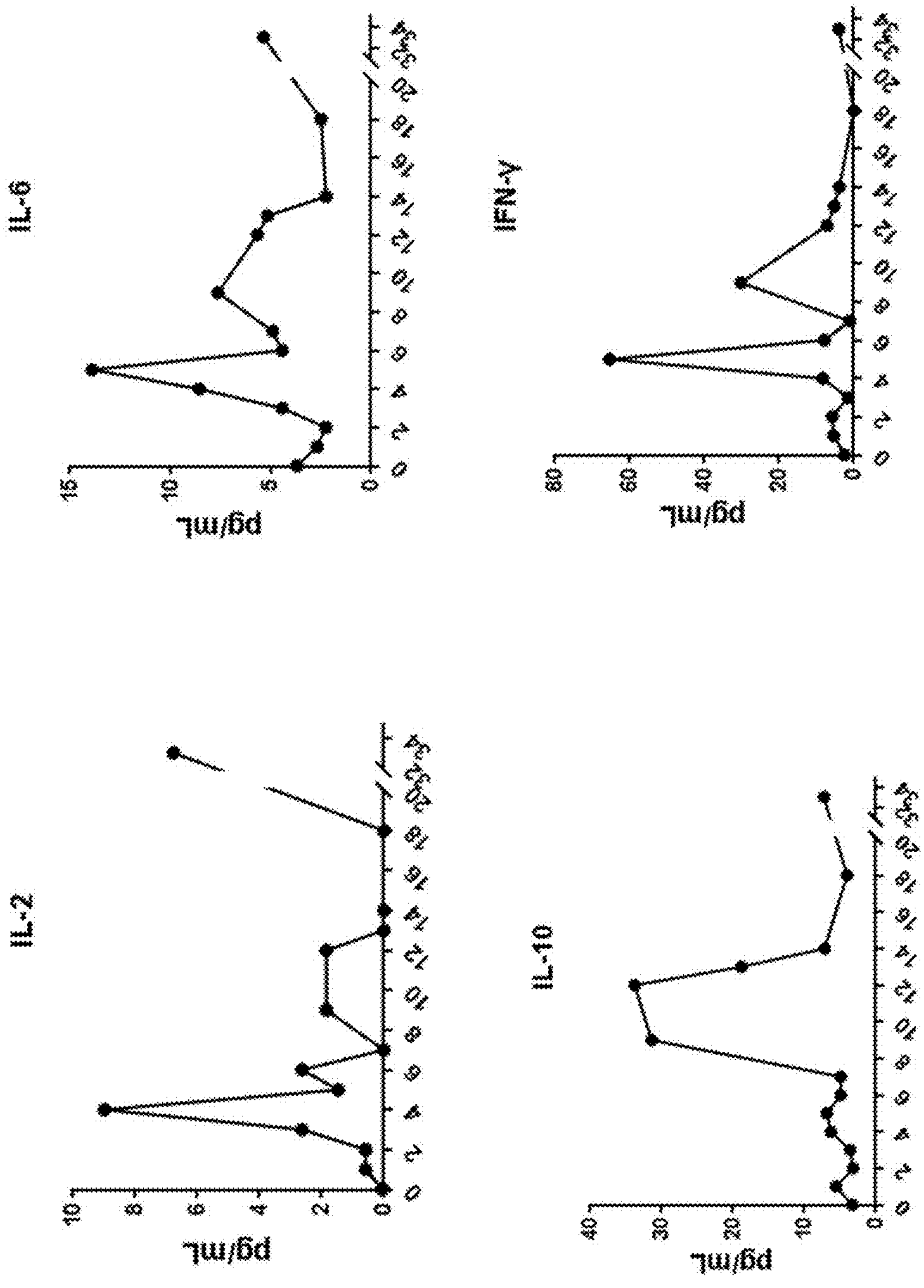
Figure 25:
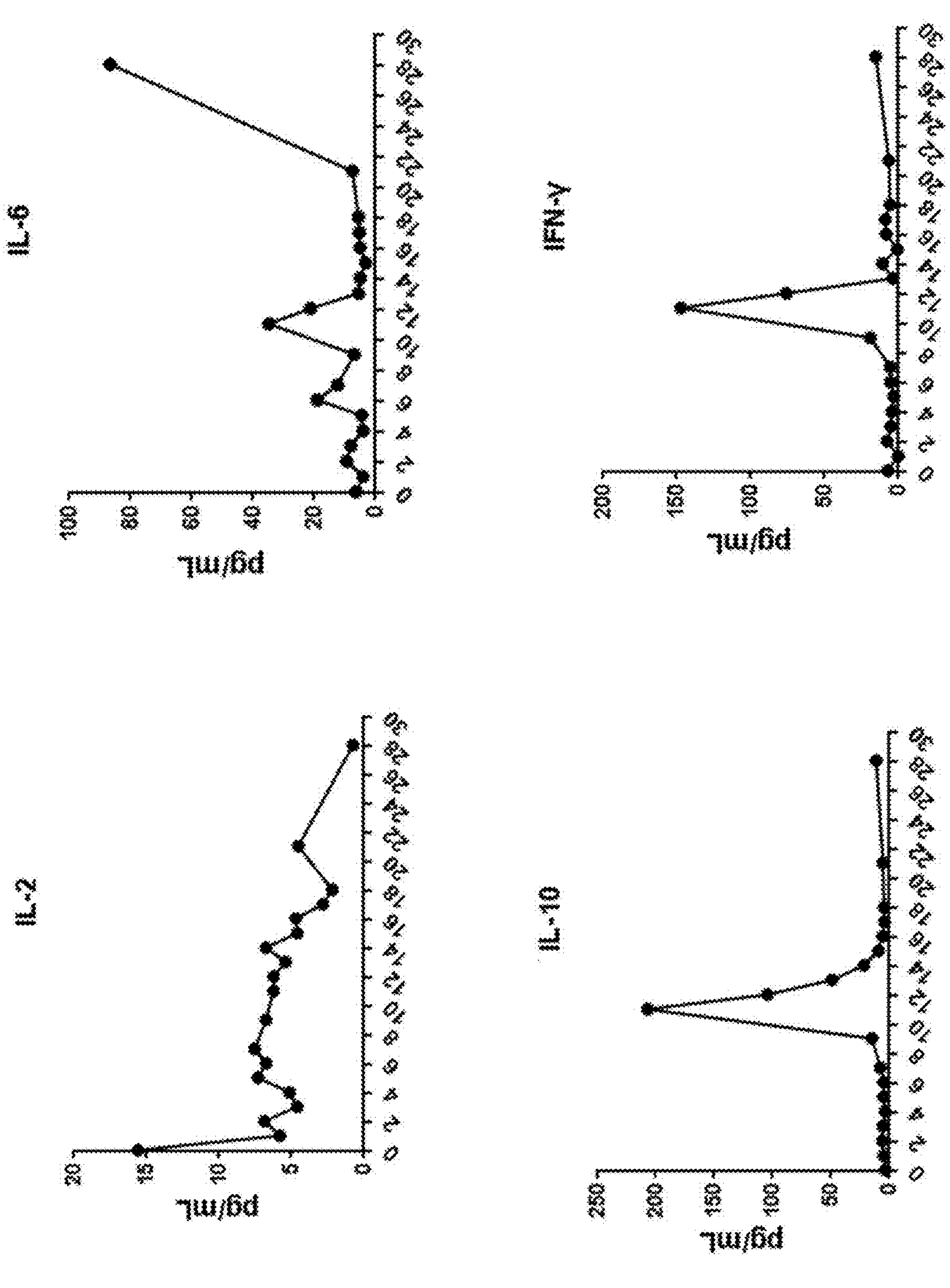
Figure 26:
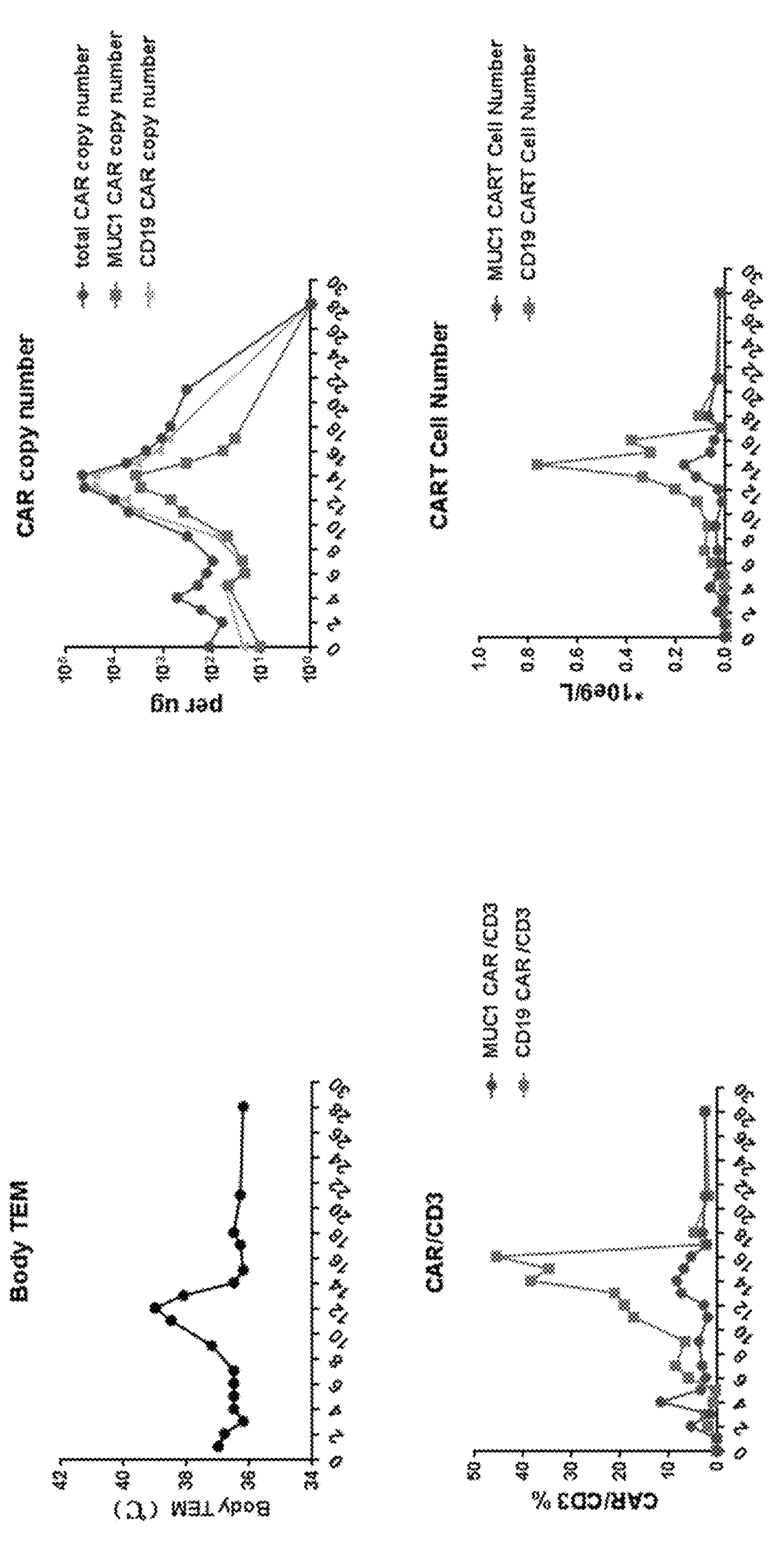
Figure 27:
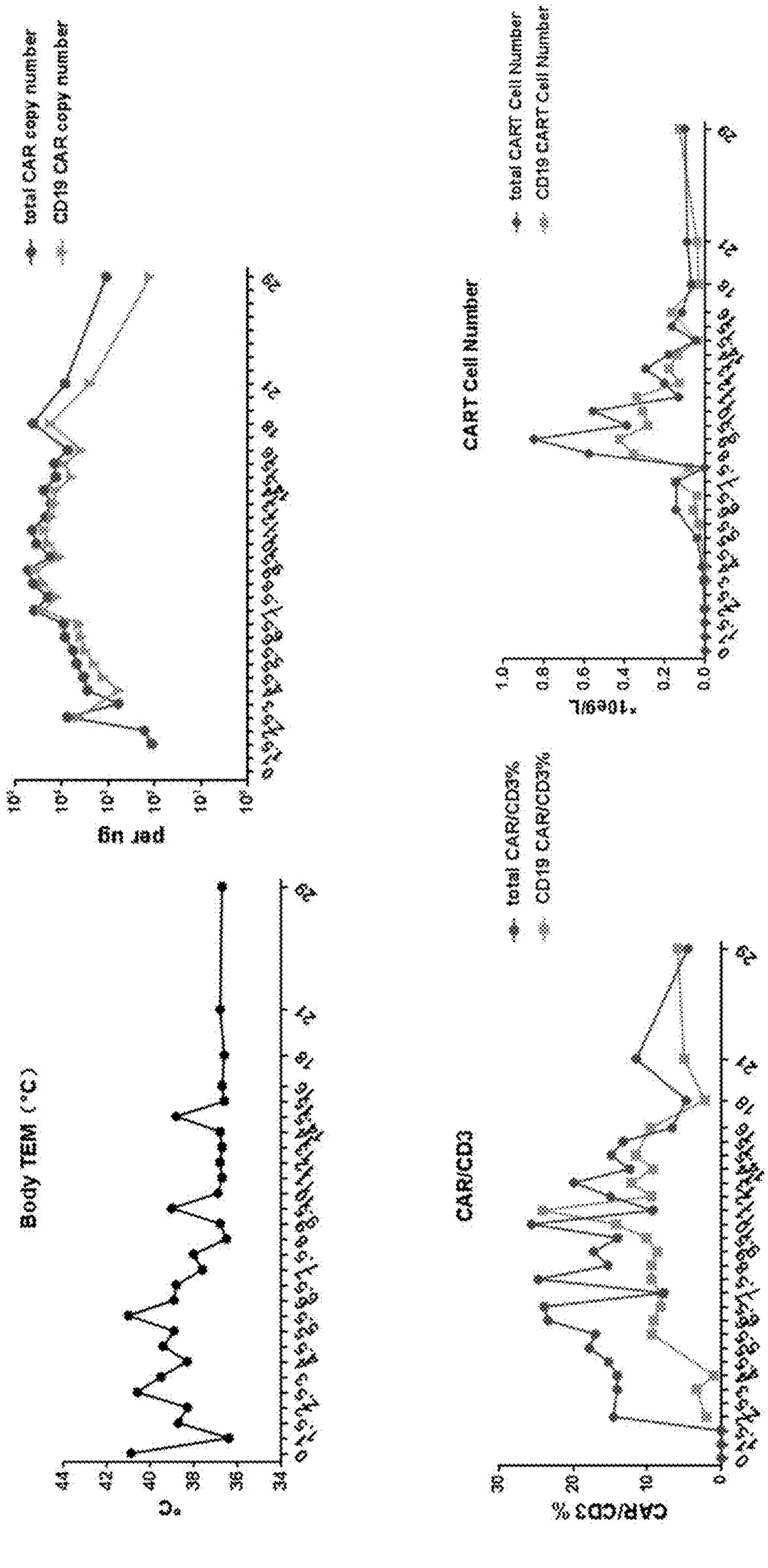
Figure 28:
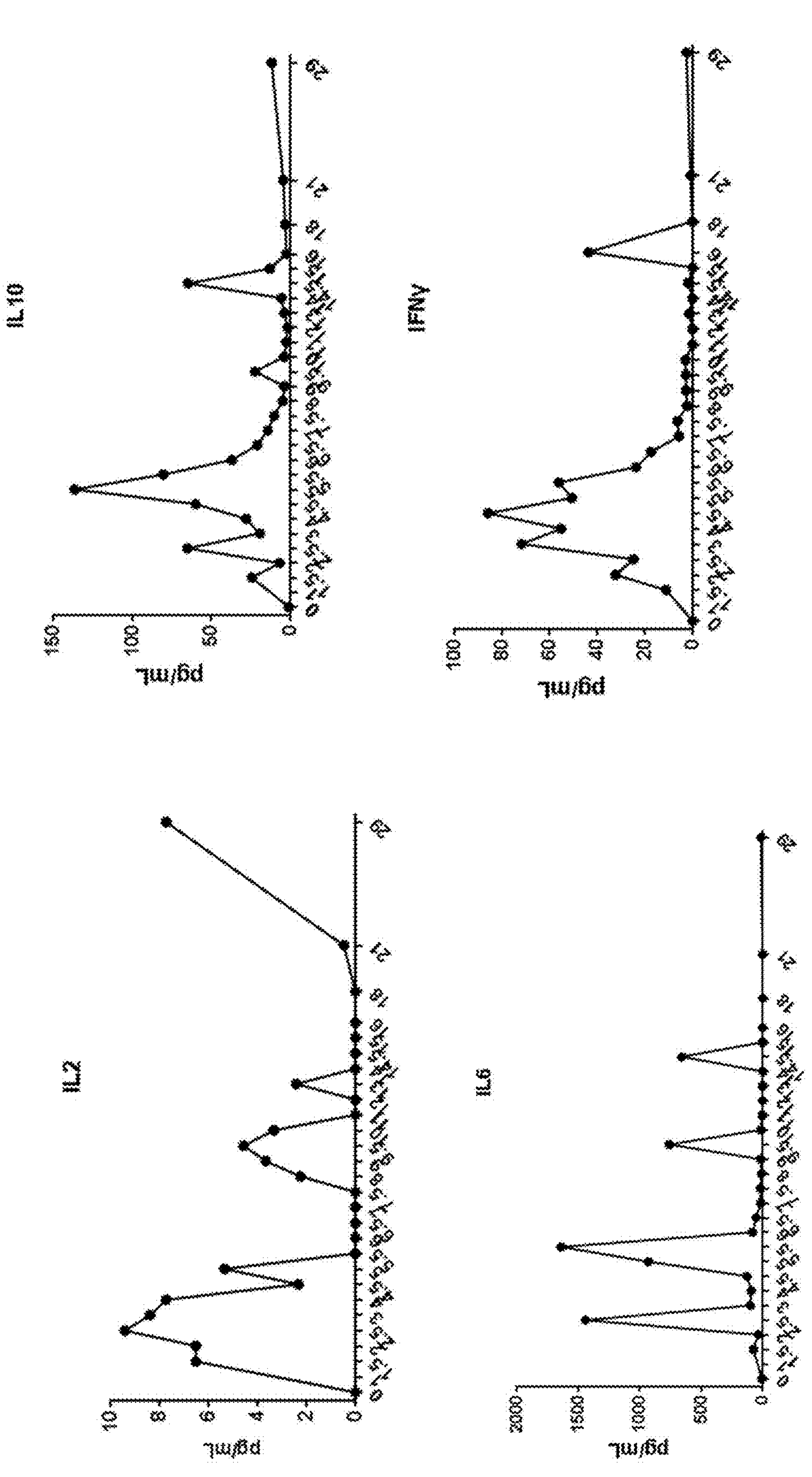
Figure 29:
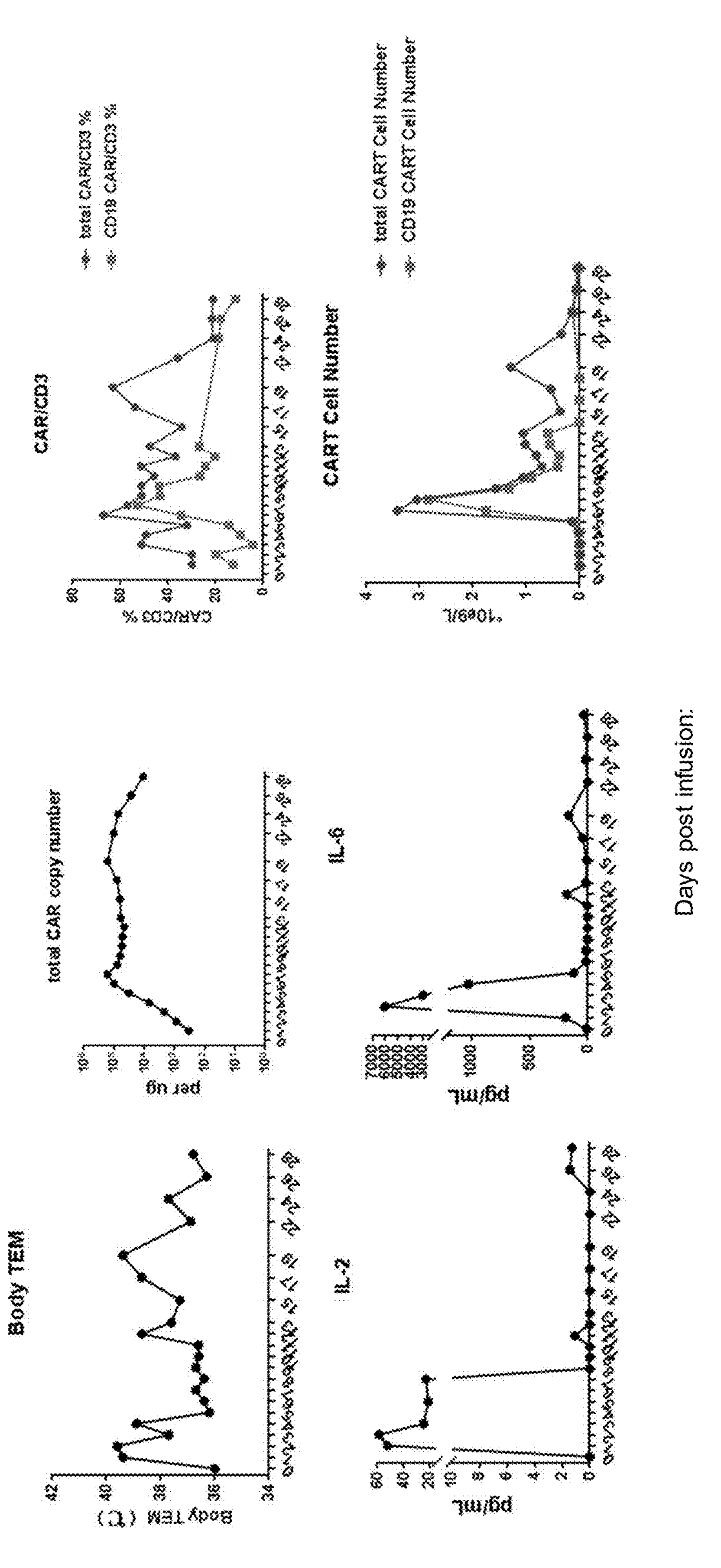
Figure 30:
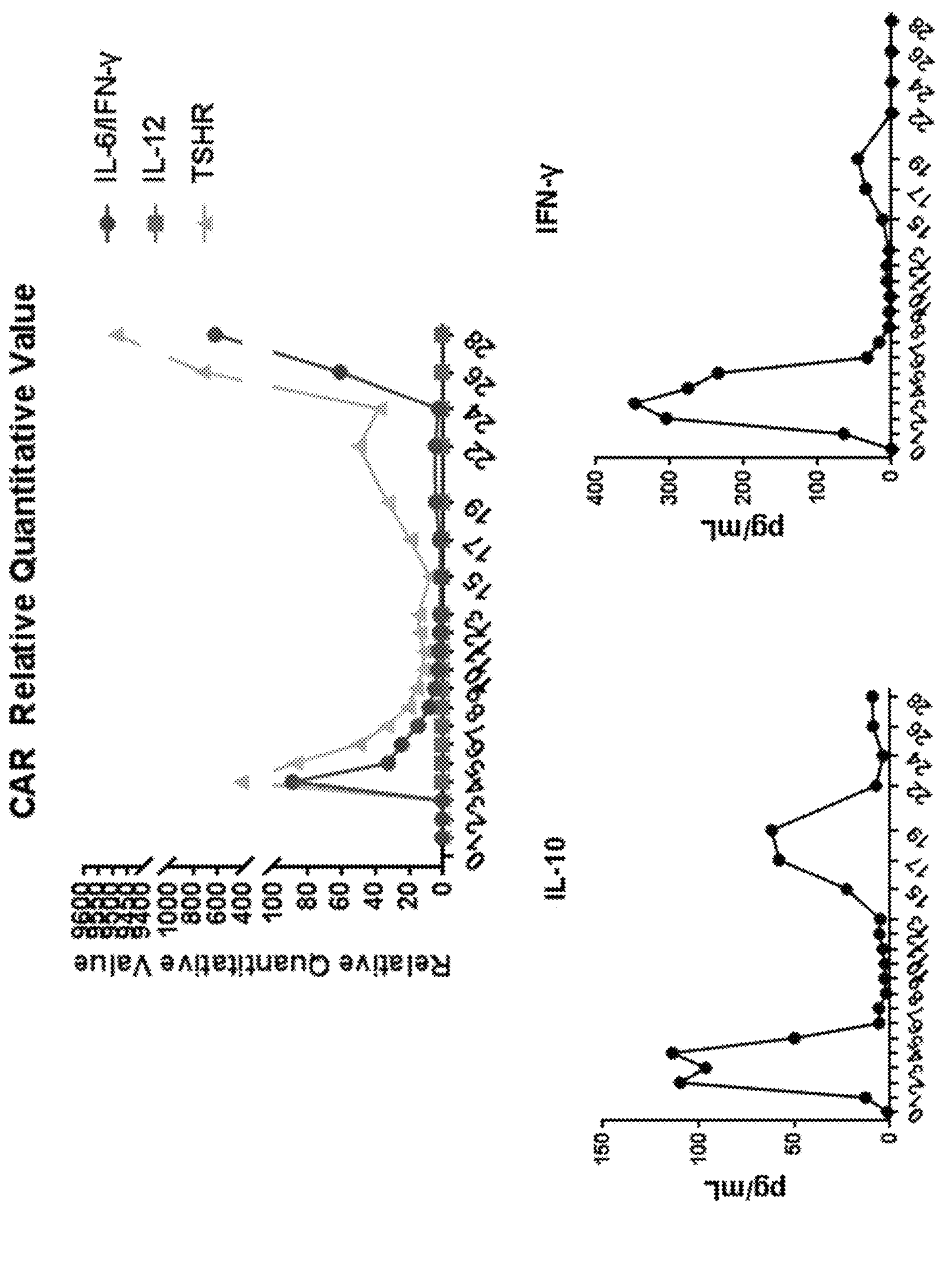
Figure 31:
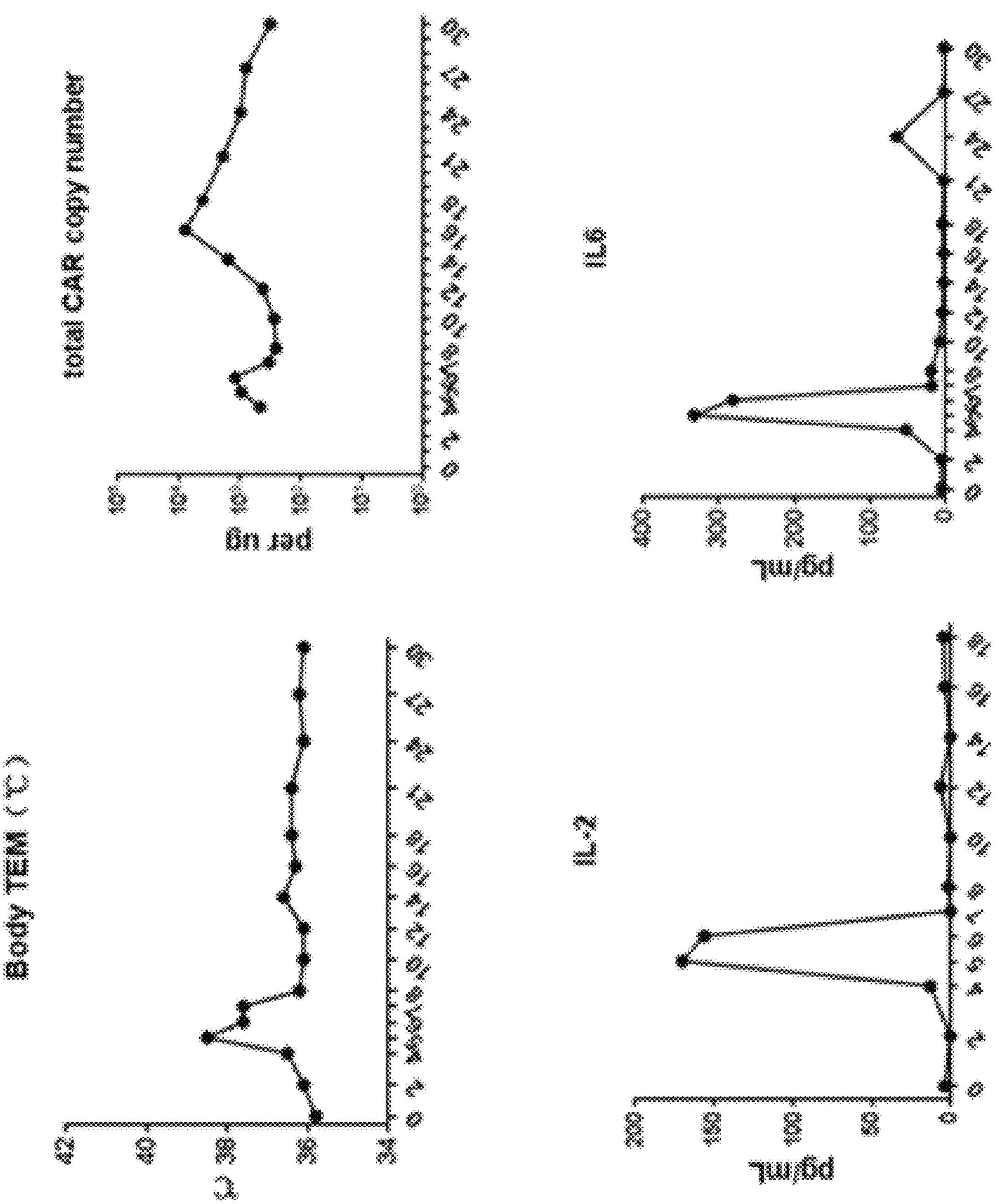
Figure 32:
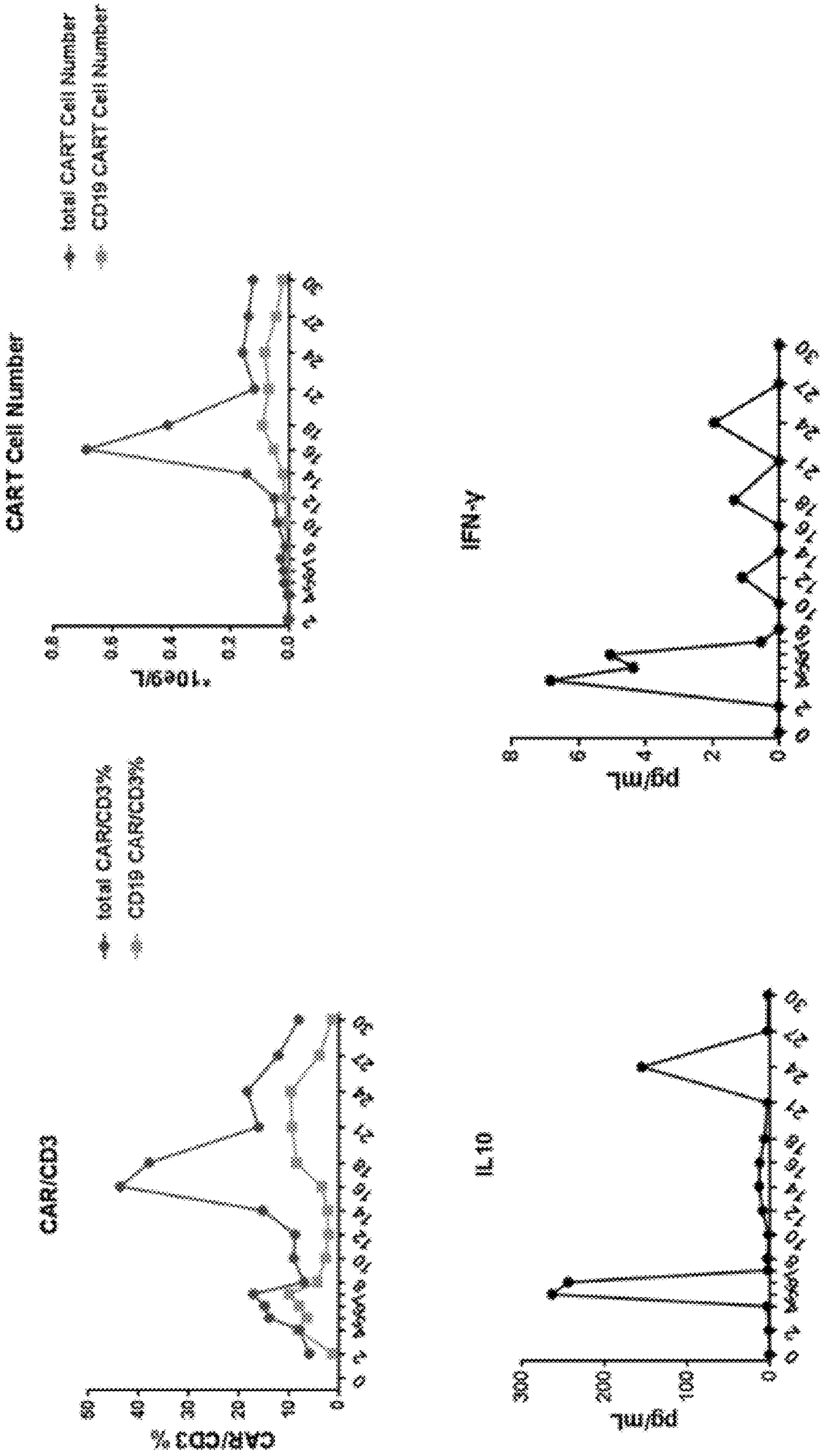

WBC×CD3%×((tMUC1CAR+CD19CAR+)/CD3), wherein WBC is the number of WBC; CD3% is the percentage of CD3 positive cells in WBC; (tMUC1CAR+CD19CAR−)/CD3 is the percentage of T cells expressing tMUC1 CAR, with no CD19 CAR in CD3 positive cells; (tMUC1CAR-CD19CAR+)/CD3 is the percentage of T cells expressing CD19 CAR, with no tMUC1 CAR in CD3 positive cells; and (tMUC1CAR+CD19CAR+)/CD3 is the percentage of T cells expressing CD19 CAR and tMUC1 CAR in CD3 positive cells. The results are shown in FIGS. 18 and 19. As shown in these figures, CD19 CAR cells significantly increased expansion of tMUC1 CAR T cells, indicating that presence of CD19 CAR enhances increased expansion of tMUC1 CAR T cells. Similar results were observed in Patients 006-010 (See FIGS. 20 and 21). Combination of in vitro results above and in vivo results in the Example below shows that activation of CAR T cells targeting WBC antigens can enhance expansion of CAR T cells targeting solid tumor antigen.

Figure 33:
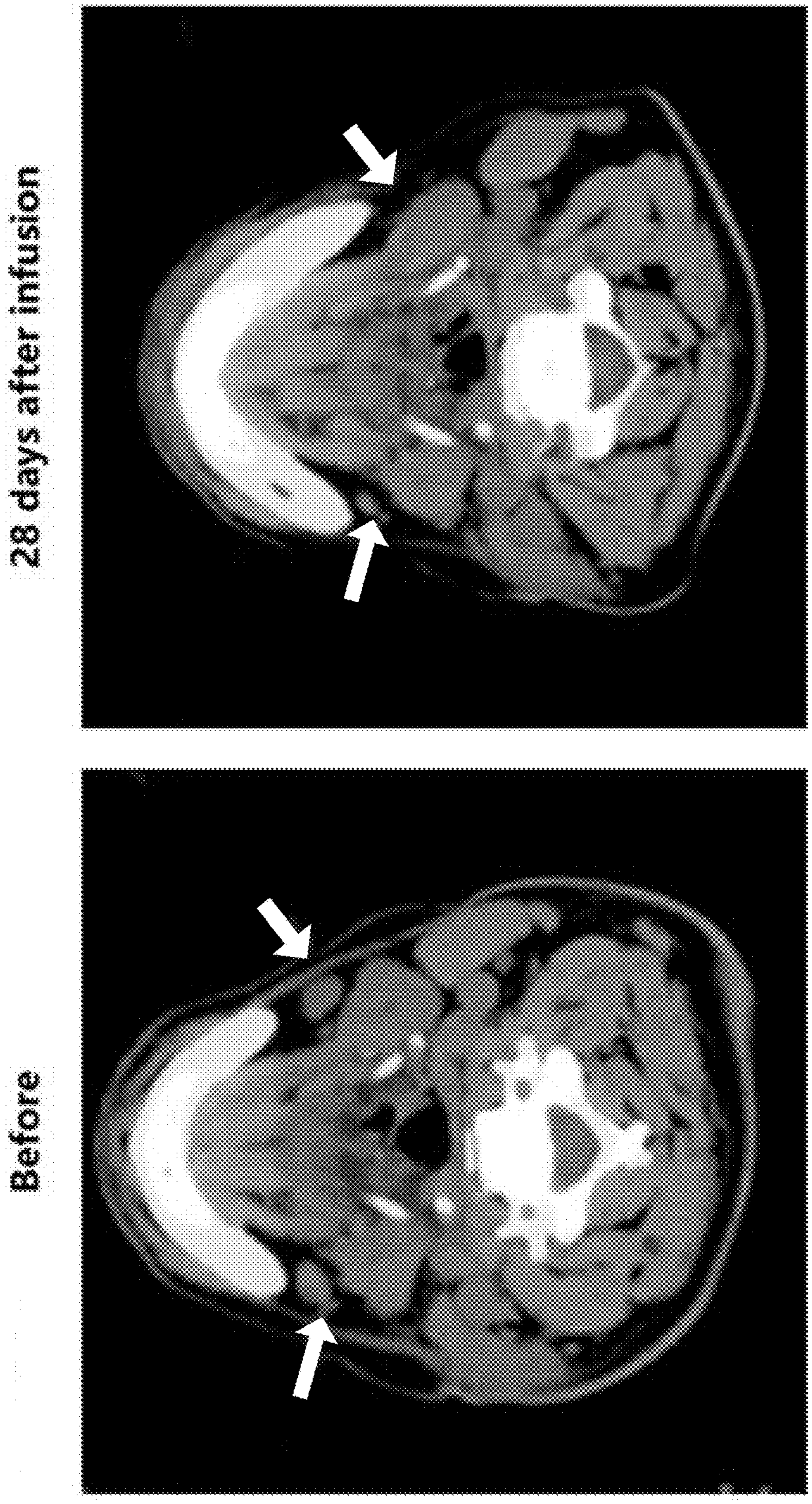
FIGS. 33, 34, and 35 show CT and/or PET CT scanning images of patients before and after the infusion of mixed CAR T cells.

Patient 008 had undergone thyroidectomy. 28 days after the infusion, the right tumor disappeared, and the size of the left tumor reduced. Examples of PET CT scanning images are shown in FIG. 33. Three months after the infusion, the right tumor did not recur, and the left tumor disappeared. The PET CT images (not shown) showed that there was no tumor recurrence or recurrence in the surgical area. After the scanning signal is enhanced, no abnormal enhancement signal is observed in the above areas. The double neck II and III areas showed multiple small lymph nodes with a maximum short diameter of no more than 10 mm. There were no abnormalities in the bilateral submandibular gland morphology and signal. At the same time, the cervical spinal cord morphology and CT signal were normal. It appeared that the patient had achieved at least partial remission (PR). During the treatment, no severe CRS (e.g., no greater than level 2 CRS) was observed in Patient 008. The patient was evaluated to achieve PR.

Figure 34:
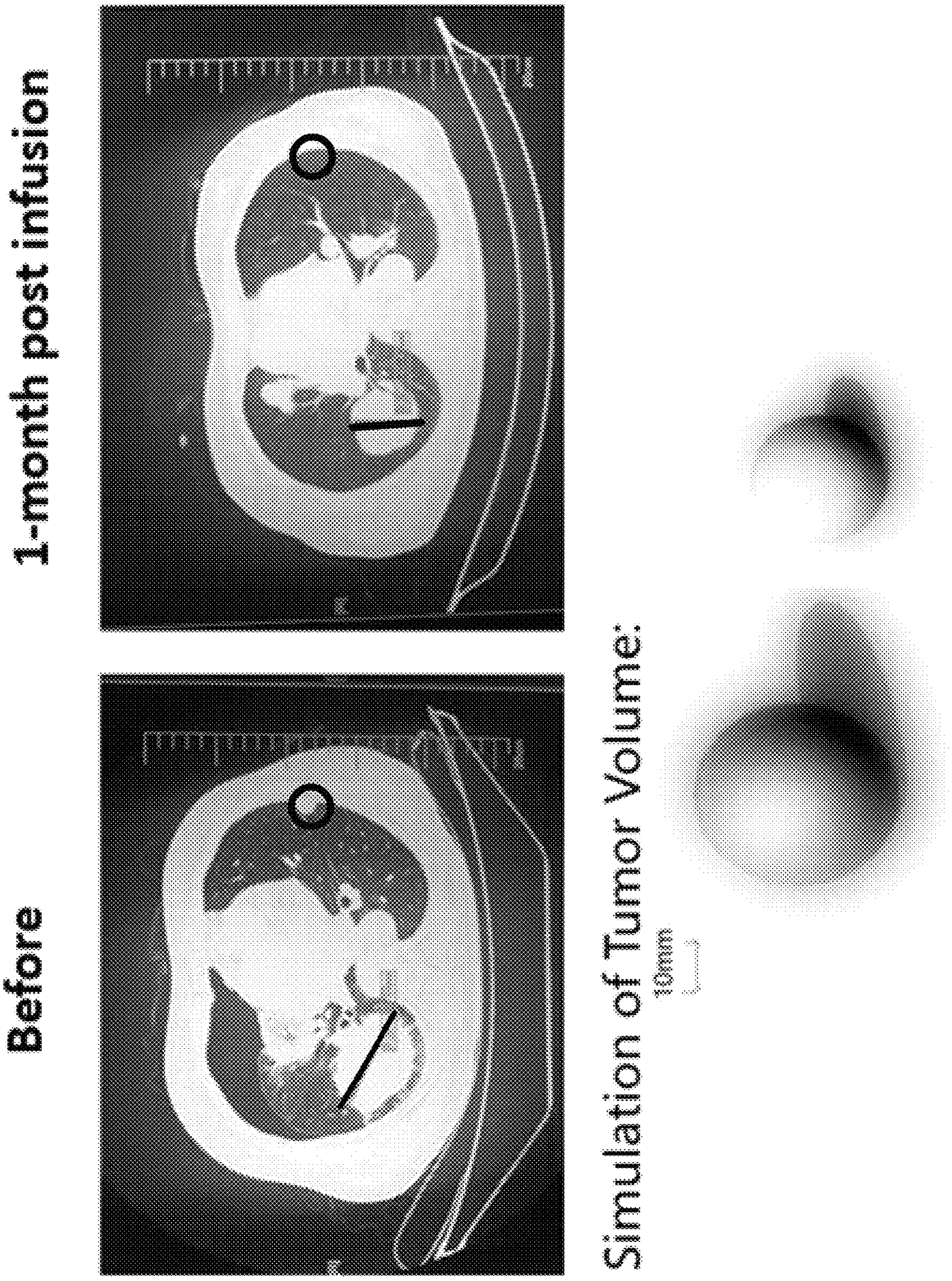

Patient 009 was diagnosed with poorly differentiated follicular papillary carcinoma with neuroendocrine carcinoma in the thyroid gland. Patient 009 underwent thyroid double lobe resection and was later examined and confirmed to have multiple lung metastases. Multiple enlarged lymph nodes were found in the mediastinum. 30 days after the infusion of CAR T cells, CT scanning showed that small tumors disappeared, and the size of the two major tumors was reduced by more than 70% (see Table 8). FIG. 34 shows that the major tumor shrunk, and the small tumor disappeared (see lines as well circles in FIG. 34). The patient was evaluated to have achieved PR.

TABLE 8

Reduction of tumor sizes on Patient 009

| Major tumor | Before Infusion (mm) | Estimated Volume ($mm^3$) | Day 4 (mm) | Estimated Volume ($mm^3$) | Day 30 (mm) | Estimated Volume ($mm^3$) | Reduced Volume |
|---|---|---|---|---|---|---|---|
| Right lower lobe | 68 × 60 | 128112.00 | 70 × 61 | 136312.63 | 42 × 39 | 33431.58 | 73.90% |
| Mediastinum and double hilar | 25 | 65416.67 | 25 | 65416.67 | 15 | 14130.00 | 78.40% |

Figure 35:
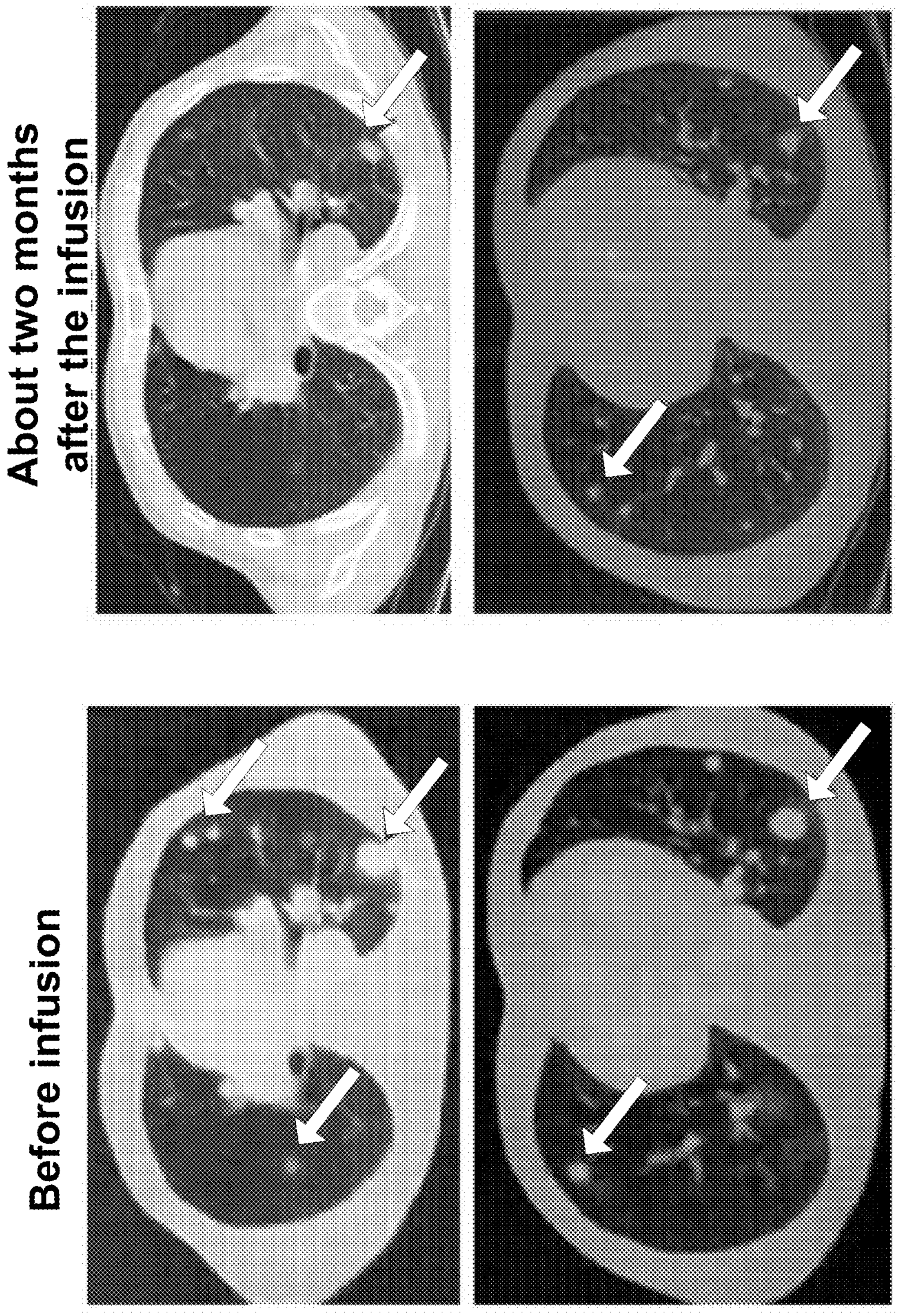

Patient 010 was diagnosed with colorectal cancer and went through 8 cycles chemotherapy as well as other treatments such as surgery before CAR T cell infusion. One month after infusion, PET-CT scanning results show most of the target lesions were significantly reduced (more than 50%), and the comprehensive calculation of tumor reduction was 44.7%. The patient was evaluated to have achieved PR (See arrows in FIG. 35).

Figure 73:
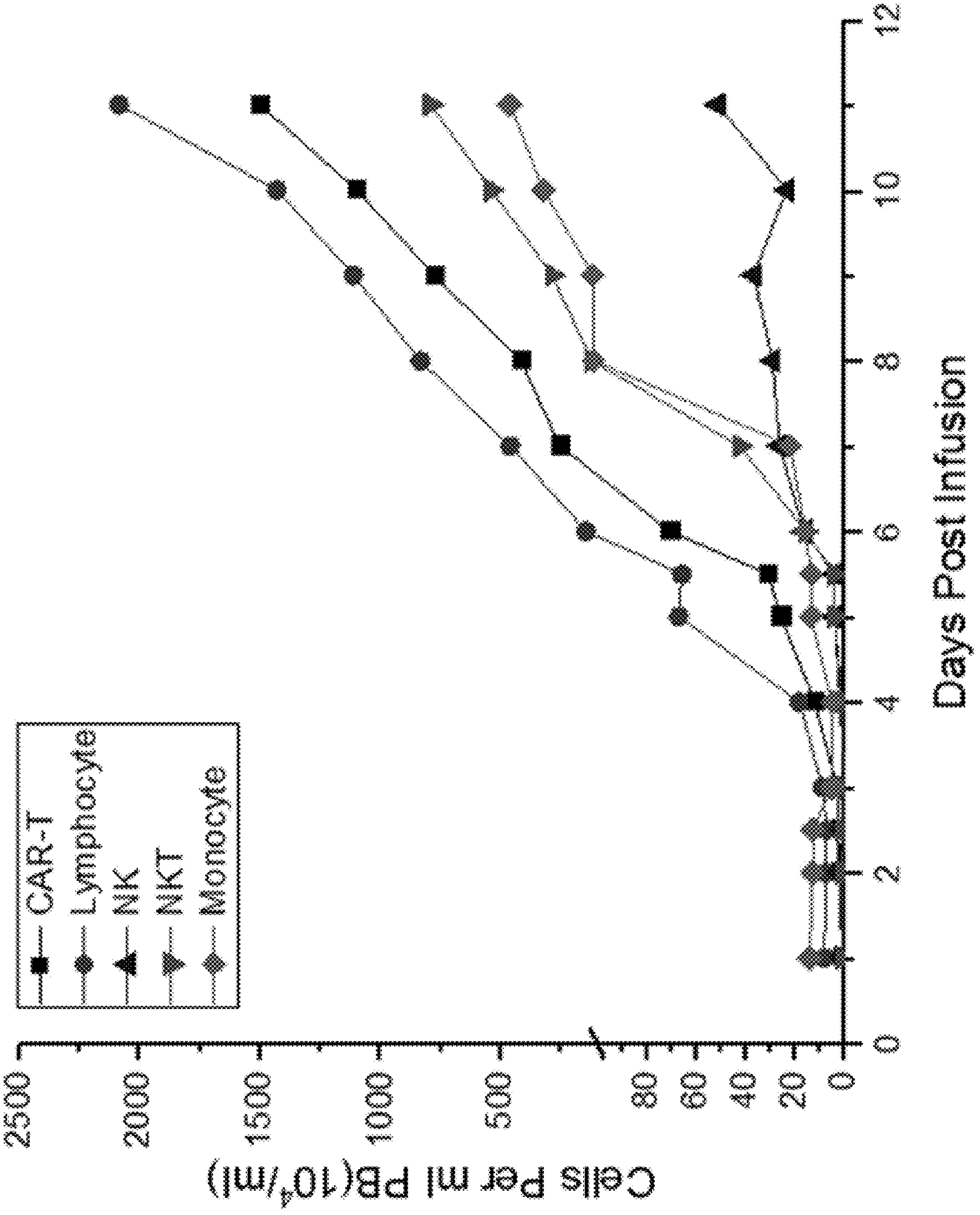
FIGS. 73, 74, and 75 show expansion of CAR T cell in Patient 011 in response to infusion of modified T cells.
Figure 74:
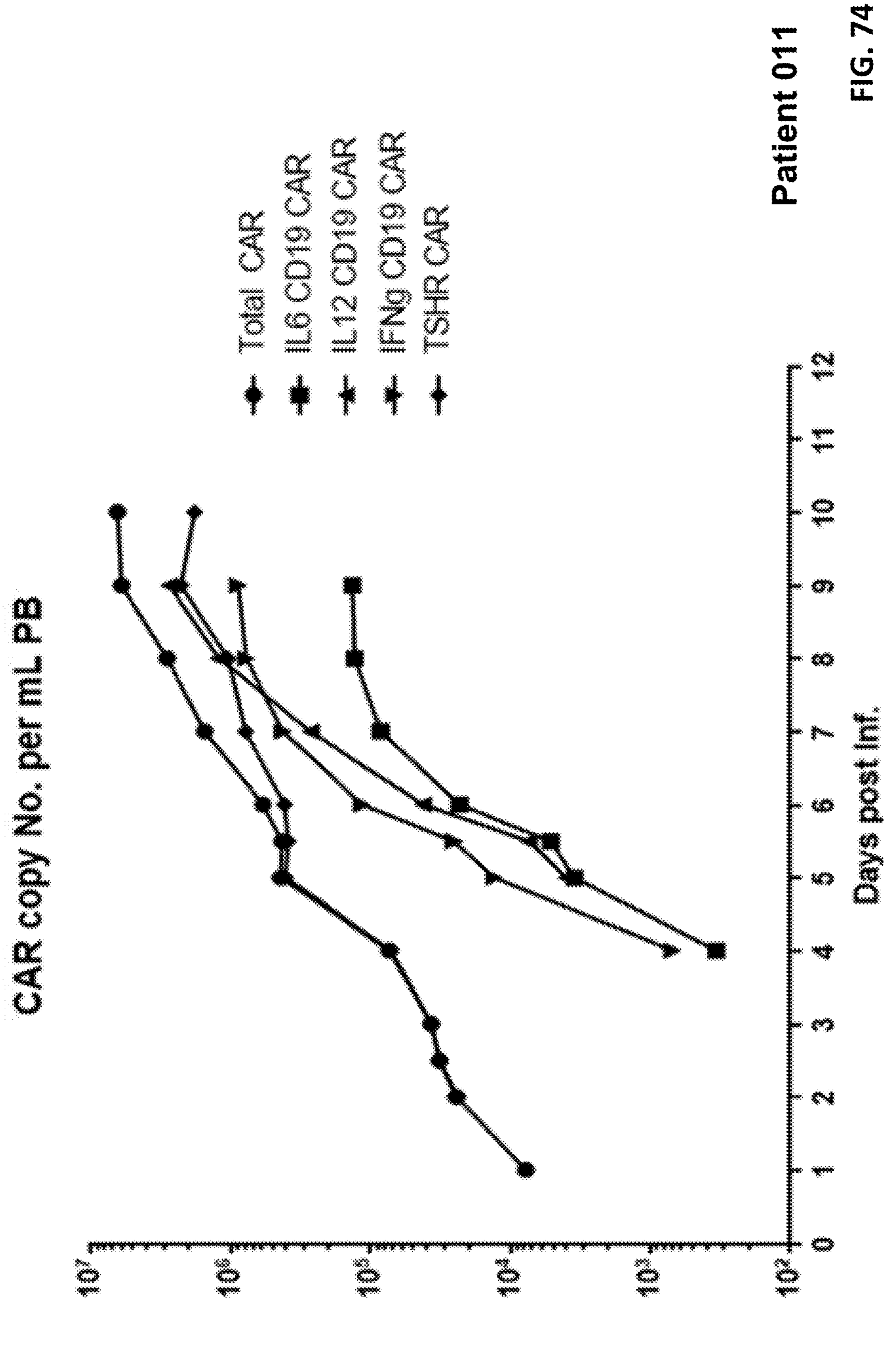
Figure 75:
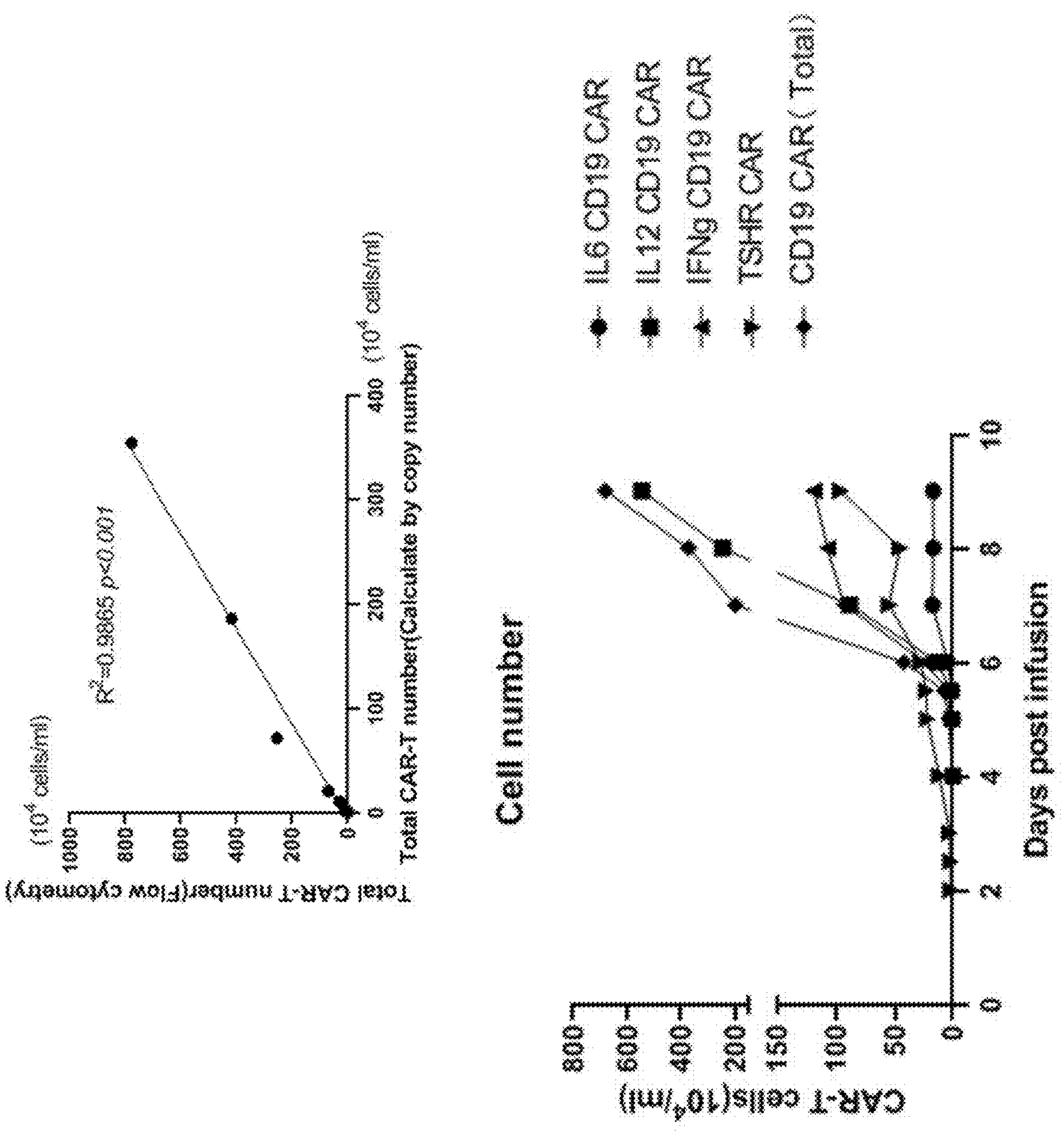
Figure 76:
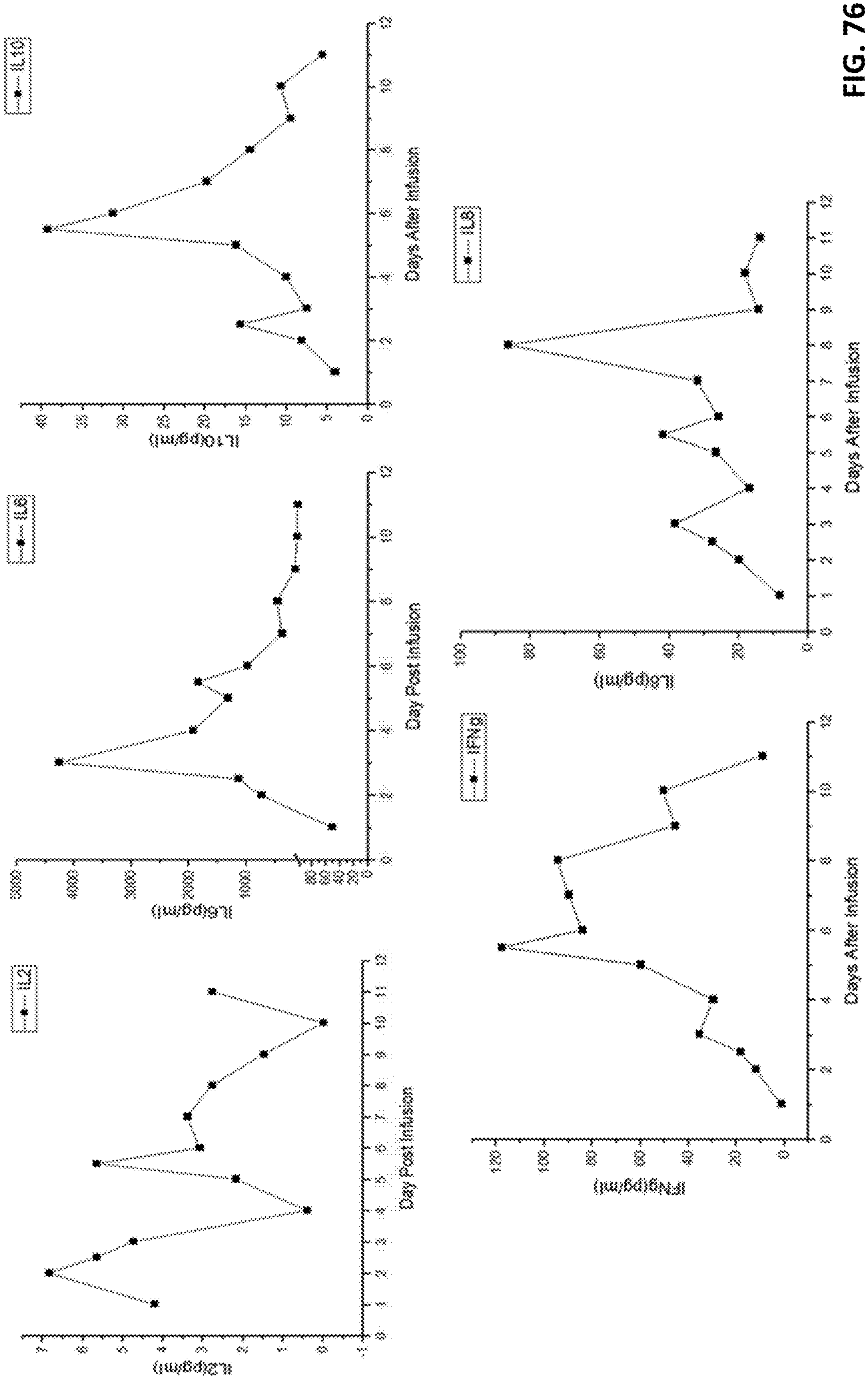
FIG. 76 shows cytokine release in Patient 011 in response to infusion of modified T cells.

Patient 011 was diagnosed with thyroid cancer. The patient's PBMC was collected and sorted using Prodigy to obtain CD3+ cells, which were then divided into six groups. Each of the six groups of cells was mixed with media containing a corresponding vector, as shown in Table 19. In these six groups of cells, there were no cells expressing both CD19 CAR and TSHR CAR. Subsequently, the six groups of cells were cultured with media without vectors to Day 7 under appropriate conditions, and cell numbers were calculated. A certain number of cells were then obtained from each group and mixed together as shown in Table 19 to obtain a mixed population of cells, which were transported to the hospital for infusion. FIG. 73 shows increases of lymphocytes including CAR T cell, natural killer cells (NK cells), natural killer T cells (NKT cells), and monocytes of Patient 011 in response to the infusion. FIGS. 74 and 75 show the increases of the number of individual CAR T cells and the total number of CAR T cells of Patient 011 in response to the cell infusion. Copy numbers of individual CAR T cell were measured to calculate the number of each type of CAR T cells and the total number of CAR T cells in the blood of Patient 011. The copy numbers and flow cytometry data were used to perform linear regression analysis and to calculate the numbers of individual CAR T cells. The linear regression analysis and expansion of the individual CAR T cells are shown in FIG. 75. These data as well as data from previous patients show that (1) CD19 CAR T cells enhanced the expansion of solid tumor CAR T cells (e.g., TSHR CAR) and (2) CD19 CAR T cells enhanced the expansion of non-CAR T cells (see individual lymphocyte number increases in FIG. 73). Further, these data indicate that this enhancement is triggered by activation of CD19 CAR and mediated by the immune cells in the patients' body, for example, the DCs. Thus, CAR T cells binding a WBC antigen (e.g., CD19 and BCMA) can also be used to enhance other T cell-based therapies (e.g., NK, TCR and TIL). For example, CD19 CAR T cells can be administered to patients combining with NK and/or T cells expressing manipulated TCR or TILs, and activation of CD19 CAR T cells can enhance expansion of these lymphocytes in the patients. FIG. 76 shows cytokine release of Patient 011 in response to cell infusion.

TABLE 19

| CAR T cells and vectors used for Patient 011. | | | | | | |
|---|---|---|---|---|---|---|
| Cell types | Group | Vectors | MOI | CAR % | Infusion CAR-T/KG | % in infused cells |
| TSHR CAR-T | 1 | TSHR scfv-41BB-CD3Z | 36.64% | 36.64% | 36.64% | 36.64% |
| | 2 | TSHR scfv-41BB-CD3Z | 39.04% | 39.04% | 39.04% | 39.04% |
| | 3 | TSHR scfv-41BB-CD3Z | 15.52% | 15.52% | 15.52% | 15.52% |
| CD19 CAR-T | 4 | CD19 scfv-41BB-CD3Z-NFAT-IFNg | 7.22% | 7.22% | 7.22% | 7.22% |
| | 5 | CD19 scfv-41BB-CD3Z-NFAT-IL6 | 0.82% | 0.82% | 0.82% | 0.82% |
| | 6 | CD19 scfv-41BB-NFAT-IL12-VHL | 0.82% | 0.82% | 0.82% | 0.82% |
| Total for infusion | | | | 40.26% | $1.25 \times 10^7$ | 100% |

The combination of in vitro results above and in vivo results in this Example shows that activation of CAR T cells targeting WBC antigens can enhance anti-tumor activity of CAR T cells targeting solid tumor antigen.

Figure 72:
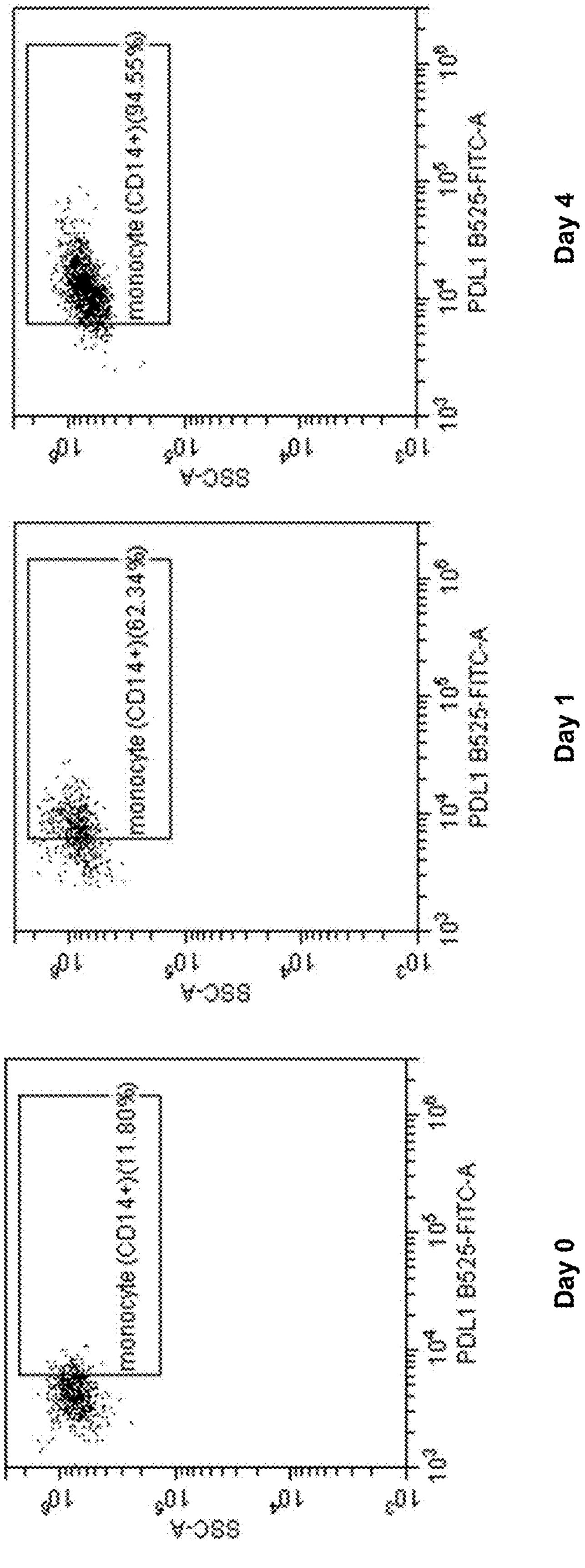
FIG. 72 shows PDL1 expression of monocytes in Patient 009.

FIG. 72 shows PDL1 expression of monocytes in Patient 009 on Day 0, Day 1, and Day 4. Monocytes were obtained from several patients, before and after infusion of the mixed CAR T cells (CD19CAR+tMuc1 CAR, CD19CAR+ GUCY2C CAR, and CD19CAR+ TSHR CAR) into the patients. The monocytes were analyzed using flow cytometry to measure the expression of markers such as PDL1. The flow cytometry results showed that the PDL1 expression was up-regulated in monocytes of patients after infusion of mixed CAR T cells. An example is shown in FIG. 72. The upregulation of PDL1 in monocytes showed the activation of monocytes, further proving the immune system of the patients was activated.

TABLE 9

| clinical trial data | | | | | |
|---|---|---|---|---|---|
| Patient's ID | Cancer | Infusion CART/kg | CAR T cell types Percentage before infusion | CSR > 2 | Efficacy |
| 001 | Breast cancer | $1 \times 10^5$<br>$1.24 \times 10^6$<br>$0.966 \times 10^7$ | N/A | No | PD (One Month) |
| 002 | Pancreatic cancer | $1.28 \times 10^6$<br>$1.29 \times 10^7$ | N/A | No | NR (One Month) |
| 003 | Thyroid cancer | $1.1 \times 10^6$ | N/A | No | NR (One Month) |
| 004 | Pancreatic cancer | $1.18 \times 10^6$ | MUC1 CAR T cells/CD3+ = 50%<br>CD19 CAR T cells/CD3+ = 15%<br>MUC1 & CD19 CAR T cells/CD3+ = 6.8% | No | PD (One Month) |
| 005 | Breast cancer | $1.03 \times 10^6$ | N/A | No | SD (One Month) |
| 006 | Breast cancer | $0.11 \times 10^6$ | N/A | No | SD (One Month) |
| 007 | Breast cancer | $1.52 \times 10^6$ | N/A | No | SD (One Month) |
| 008 | Thyroid cancer | $2.08 \times 10^9$ | TSHR + CD19 CAR T cells/CD3+ = 33.04%<br>CD19 CAR T cells/CD3+ = 21.96% | No | PR (See FIG. 33) |
| 009 | Thyroid cancer | $1.36 \times 10^9$ | TSHR + CD19 CAR T cells/CD3+ = 42.64%<br>CD19 CAR T cells/CD3+ = 12.37% | No | PR (See FIG. 34) |
| 010 | Colorectal cancer | $3.78 \times 10^8$ | GUCY2C + CD19 CAR T cells/CD3+ = 15.55% | No | PR (See FIG. 35) |
| 011 | Thyroid cancer | $1.25 \times 10^7$ | CAR/CD3+ = 40.26%<br>CD19 CAR/CD3+ = 2.25%<br>TSHR CAR/CD3+ = 38.1% | No | N/A |

TABLE 10 cell manufacture for clinical trials

| Patient's ID | Vectors and MOI | Infusion Methods | Pre-treatment |
|---|---|---|---|
| 001 | Vector 1: MUC1-CAR (scFv of the CAR is SEQ ID NO: 70): 30:1 | Fresh (first infusion) and Cryopreserved (second infusion) cells | cyclophosphamide 1.5 grams/m2 in −3 days |
| 002 | Vector 1: MUC1-CAR (scFv of the CAR is SEQ ID NO: 70): 30:1 | Fresh cells | No |
| 003 | Vector 2: TSHR-CAR (scFv of the CAR is SEQ ID NO: 8): 100:1 | Fresh cells | FC regimen at −5 to −3 days (cyclophosphamide 500 mg/m2, fludarabine 30 mg/m2) |
| 004 | Vector 1: MUC1-CAR (scFv of the CAR is SEQ ID NO: 70): 19:1 Vector 2: hCD19-CAR (scFv of the CAR is SEQ ID 5): 5:1 | Fresh cells | FC regimen at −5 to −3 days (cyclophosphamide 500 mg/m2, fludarabine 30 mg/m2) |
| 005 | Vector 1: MUC1-CAR /Dominant Negative PD-1(scFv of the CAR is SE Q ID NO: 70 and 89): 18: 1 Vector 2: hCD19-CAR (scFv of the CAR is SEQ ID 5): 5:1 | Fresh cells | No |
| 006 | Vector 1: MUC1-CAR (scFv of the CAR is SEQ ID NO: 70): 19:1 Vector 2: hCD19-CAR (scFv of the CAR is SEQ ID 5): 5: 1 | Fresh cells | cyclophosphamide 1.5 grams/m2 in −3 days |
| 007 | Vector 1: MUC1-CAR (scFv of the CAR is SEQ ID NO: 70): 19:1 Vector 2: hCD19-CAR (scFv of the CAR is SEQ ID 5): 5:1 | Cryopreserved cells | cyclophosphamide 1.5 grams/m2 in −3 days |
| 008 | Vector 1: TSHR-CAR (CAR: SEQ ID NO: 279, scFv of the CAR: SEQ ID NO: 8): 19: 1 (MOI); and Vector 2: hCD19-CAR-NATF-IL6-2A-IFNγ (Vector SEQ ID NO: 480, scFv of CD19 CAR: SEQ ID 5, 6xNFAT: SEQ ID: 481, aa of IL6: SEQ ID NO: 482, 2A is SEQ ID NO: 483, and aa of IFN-γ: SEQ ID NO: 484 (See the construct of Embodiment 1 of FIG. 63)): 5: 1 (MOI) | Fresh cells | FC regimen at −5 to −3 days (cyclophosphamide 500 mg/m2, fludarabine 30 mg/m2) |
| 009 | Vector 1: TSHR-CAR (CAR: SEQ ID NO: 279, scFv of the CAR: SEQ ID NO: 8): (See MOI in Table 7); Vector 2: hCD19-CAR-NATF-IL6-2A-IFNγ (Vector SEQ ID NO: 480, scFv of CD19 CAR: SEQ ID 5, 6xNFAT: SEQ ID: 481, aa of IL6: SEQ ID NO: 482, 2A is SEQ ID NO: 483, and aa of IFN-γ: SEQ ID NO: 484 (See the construct in Embodiment 1 of FIG. 63)) (See MOI in Table 7); and Vector 3: hCD19-CAR-NATF-IL12-VHL (Vector SEQ ID NO: 485, scFv of CD19 CAR: SEQ ID 5, 6xNFAT: SEQ ID: 481, aa of IL12: SEQ ID NO: 486, VHL: SEQ ID NO: 487 (See the construct of Embodiment 3 of FIG. 63) (See MOI in Table 7). | Fresh cells | FC regimen at −5 to −3 days (cyclophosphamide 600 mg, fludarabine 50 mg) |
| 010 | Vector 4: GUCY2C-CAR (CAR: SEQ ID NO: 488, scFv of the CAR: SEQ ID NO: 11): 50: 1(MOI); and Vector 2: hCD19-CAR-NATF-IL6-2A-IFNγ (Vector SEQ ID NO: 480, scFv of CD19 CAR: SEQ ID 5, 6xNFAT: SEQ ID: 481, aa of IL6: SEQ ID NO: 482, 2A is SEQ ID NO: 483, and aa of IFN-γ: SEQ ID NO: 484 (See the construct of Embodiment 1 of FIG. 63)): 10: 1 (MOI) | Fresh cells | FC regimen at −2 days (cyclophosphamide 500 mg/m2, fludarabine 30 mg/m2) |
| 011 | Vector 1: TSHR-CAR (CAR: SEQ ID NO: 279, scFv of the CAR: SEQ ID NO: 8) (See MOI in Table 19); Vector 3: hCD19-CAR-NATF-IL12-VHL (Vector SEQ ID NO: 485, scFv of CD19 CAR: SEQ ID 5, 6xNFAT: SEQ ID: 481, aa of IL12: SEQ ID NO: 486, VHL: SEQ ID NO: 487 (See the construct of Embodiment 3 of FIG. 63) (See MOI in Table 19); and Vector 4: hCD19-CAR-NATF-IFNγ (Vector SEQ ID NO: 480, scFv of CD19 CAR: SEQ ID 5, 6xNFAT: SEQ ID: 481, and aa of IFN-γ: SEQ ID NO: 484 (See the construct in Embodiment 5 of FIG. 63)) (See MOI in Table 19); and Vector 5: | Fresh cells | FC regimen at −2 days (cyclophosphamide 500 mg/m2, fludarabine 30 mg/m2) |

TABLE 10-continued

| cell manufacture for clinical trials | | | |
|---|---|---|---|
| Patient's ID | Vectors and MOI | Infusion Methods | Pre-treatment |
| | hCD19-CAR-NATF-IL6 (Vector SEQ ID NO: 480, scFv of CD19 CAR: SEQ ID 5, 6xNFAT: SEQ ID: 481, and aa of IL6: SEQ ID NO: 482 (See the construct in Embodiment 4 of FIG. 63)) (See MOI in Table 19); | | |

Example 3. Activation of Coupled/Mixed T Cells

Mixed CAR T cells (Coupled CAR T cells) were divided into three Groups for assays related to activation: CD19 CAR and tMUC1 CAR (Group 1), anti-CD19 CAR and ACPP CAR (Group 2), and CD19 and CLDN18.2 CAR (Group 3). Peripheral blood of healthy volunteers was collected. CD3+ T cells were sorted using Pan T kits, and CD3/CD28 Dynabeads were added at a 1:1 ratio. CD3+ T cells were then transfected with lentivirus. The lentivirus and the Dynabeads were removed, and fresh media were added. CAR ratios and cell phenotype were determined. Expression of CAR in these three groups of cells was measured. CD19 CAR T cells, tMUC1 CAR T cells, and target cells were selected and mixed for 24 hours or 48 hours. Expression of various markers in corresponding cells was measured. $20\times10^4$ CAR T cells and $20\times10^4$ substrate cells were co-cultured for 24 hrs. The expression of molecules such as hCAR (humanized scFv), mCAR (murine scFv), CD25, and CD137 in T cells was measured by flow cytometry. For example, CD25 and CD137 positive staining indicated that T cells were activated. Amounts of cytokines released from various T cells were measured in response to the antigen activation, and background of the corresponding T cells was subtracted.

Tables 11, 12, and 13 provide information for CAR T cells and corresponding substrate cells of Group 1, Group 2, and Group 3, respectively. For example, CAR 1204 is a human-derived CAR, which can be labeled with human CAR antibody and CD137 antibody. CAR 2407 (tMUC1 CAR) is a murine CAR that can be labeled for activation with a murine CAR antibody and a CD137 antibody. Cells expressing CAR 1204 (CD19 CAR T cells) can be activated by K562 cells expressing CD19, resulting in up-regulated CD137 expression. CAR 1204 cells, CAR 2407 cells, and K562 cells expressing CD19 were co-cultured to induce CD19 CAR T cell activation. The binding domains of CD19 CAR and tMUC1 CAR include SEQ ID NOs: 5 and 70, respectively. The activation of 2407 CAR T cells was detected and measured based on the expression of CD137, which evidence the indirect activation of CD19 CAR T cells.

TABLE 11

| CAR T cells and substrate cells used in Group 1 | | | |
|---|---|---|---|
| | CD19 CAR T Cells & tMUC1 CAR T Cells | | |
| Coupled CAR T Cells CART cell ID | CAR | Substrate cell ID | Notes |
| 1234 | CD19 CAR | K19 | CD19 positive Cell |
| 2407 | tMUC1 CAR | MCF-17 | 5E5 (tMUC1) positive cell |

Figure 36:
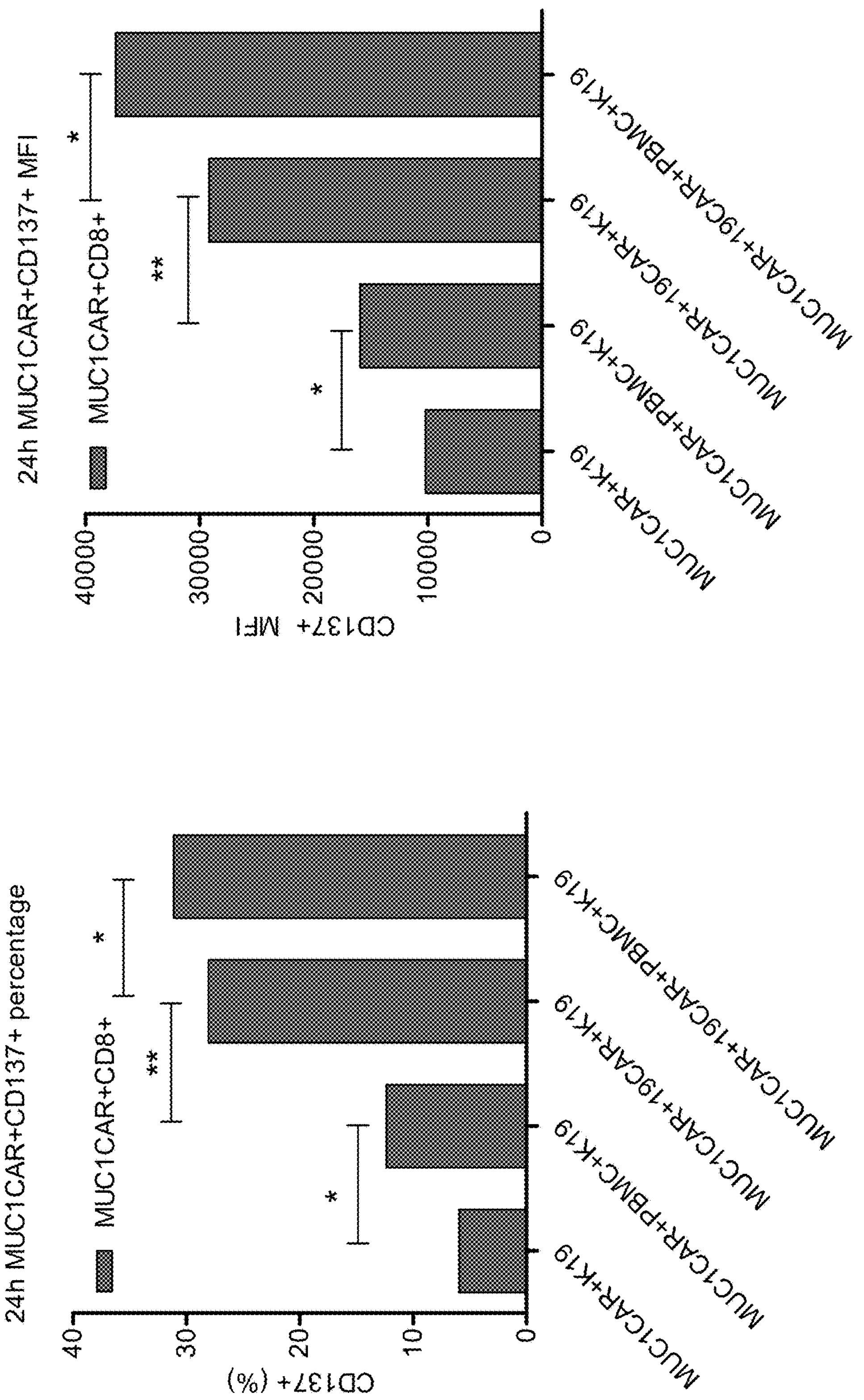
FIG. 36 shows results of flow cytometry analysis of CD19 CAR T cells co-cultured with tMUC1 CAR T cells in the presence or the absence of K19 cells.

FIG. 36 shows results of flow cytometry analysis of CD19 CAR T cells co-cultured with tMUC1 CAR T cells in the presence or absence of K19 cells.

Peripheral blood of healthy volunteers was collected on Day 0. CD3+ T cells were sorted using Pan T kits, and CD3/CD28 Dynabeads were added to the collected CD3+ T cells at a 1:1 ratio. On Day 1, the activated CD3+ T cells were divided into two subgroups, each transfected with lentivirus encoding a single CAR (CD19 CAR or tMUC1 CAR). Thus, two subgroups of CAR T cells were obtained: a subgroup of CAR T cells expressing CD19 CAR, and another subgroup of CAR T cells expressing tMUC1 CAR. The binding domains of CD19 CAR and tMUC1 CAR include SEQ ID NOs: 5 and 70, respectively. On Day 2, the lentivirus and the Dynabeads were removed, and fresh media were added. On Day 7, CAR T cells and target cells were co-cultured for 24 hours, and various assays were performed on Day 8. Subgroups of cells can be mixed and co-cultured with corresponding substrate cells (see FIGS. 36-60).

FIG. 36 provides histograms showing CD137 expression in various cell cultures. In each cell culture, CAR T cells were cultured with the corresponding substrate cells, and CD137 expression was measured using flow cytometry (Gate mCAR+: tMUC1CAR). The cell cultures include (1) tMUC1CAR T cells and K19, (2) tMUC1CAR T cells, K19, and PBMC, (3) tMUC1CAR T cells, CD19CAR T cells and K19, (4) tMUC1CAR CAR T cells, CD19 CAR T cells, K19, and PBMC. The CD8+ T cells were also counted. As shown in FIG. 36, the activation of tMUC1CAR T cells (i.e., expression of CD137) was observed in the presence of K19, and the activation level of MUC1 CAR T cells was higher than that of the single group. Further, the level of activation was higher after adding PBMC (e.g., MFI of CD137). These results indicate that the activation of CD19 CAR T cells by K19 activates tMUC1 CAR T cells in the absence of the antigen that tMUC1 CAR binds (tMUC1), and this activation is enhanced by the presence of PBMC. The experimental results are based on the expression ratio as the main basis for measuring the difference (left). When the proportional difference is not significant, the expression intensity (MFI) is used as a measure of the difference (right).

Figure 37:
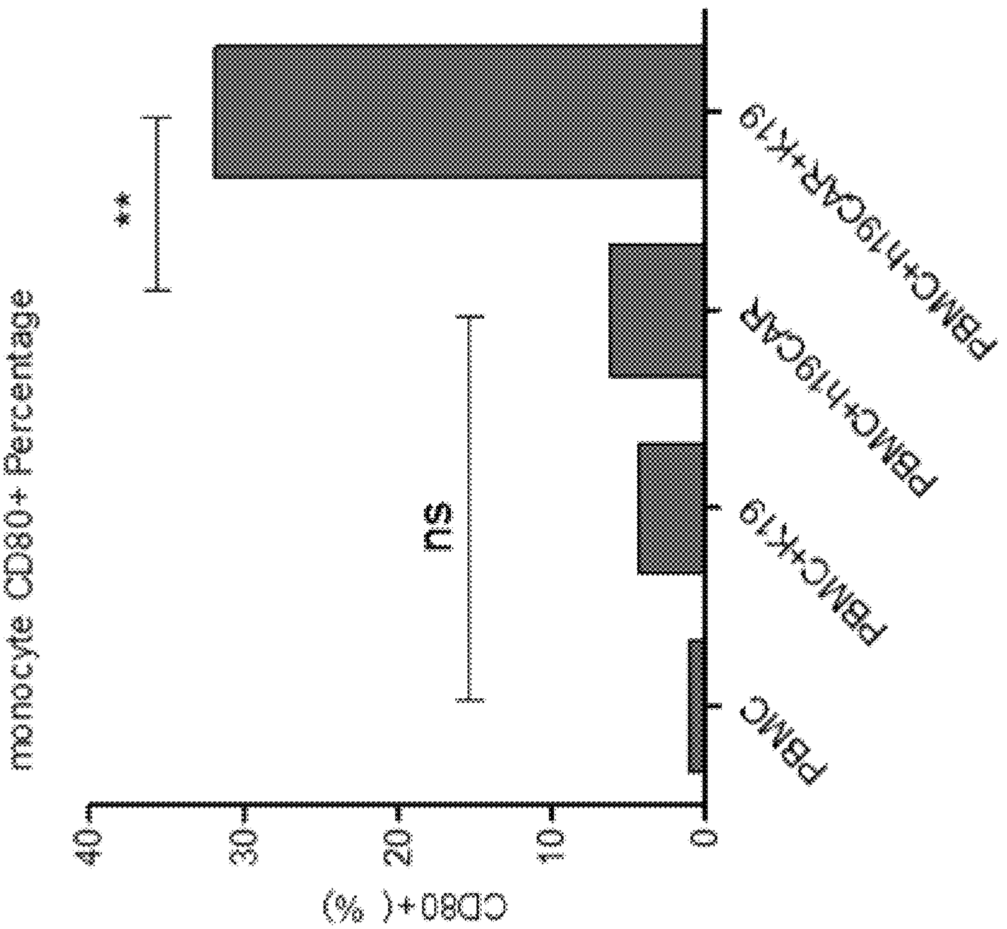
FIG. 37 shows the activation of PBMC and monocytes in the cell cultures used in the assay of FIG. 36.

FIG. 37 shows the activation of PBMC and monocytes in the cell cultures described in FIG. 36. Flow cytometry assays of monocyte (CD14+) and activated monocyte (CD14+CD80+) were performed in PBMC, and FIG. 37 shows a histogram of statistical analysis of the assays. h19CAR is a humanized CD19CAR, and the cell cultures include (1) PBMC alone, (2) PBMC+K19, (3) PBMC and CD19CAR T cells, (4) PBMC, K19, and CD19CAR T cells. As shown in FIG. 37, the last group of PBMCs showed activation (CD80 expression). These results show that activation of the CAR T cells is capable of activating PBMC including monocytes. Combination of the results shown in FIGS. 36 and 37 indicates that activation of CD19 CAR T cells by K19 activates tMUC1CAR T cells in the absence of the antigen that tMUC1 CAR binds, and this activation can be mediated at least partially through PBMC.

Figure 38:
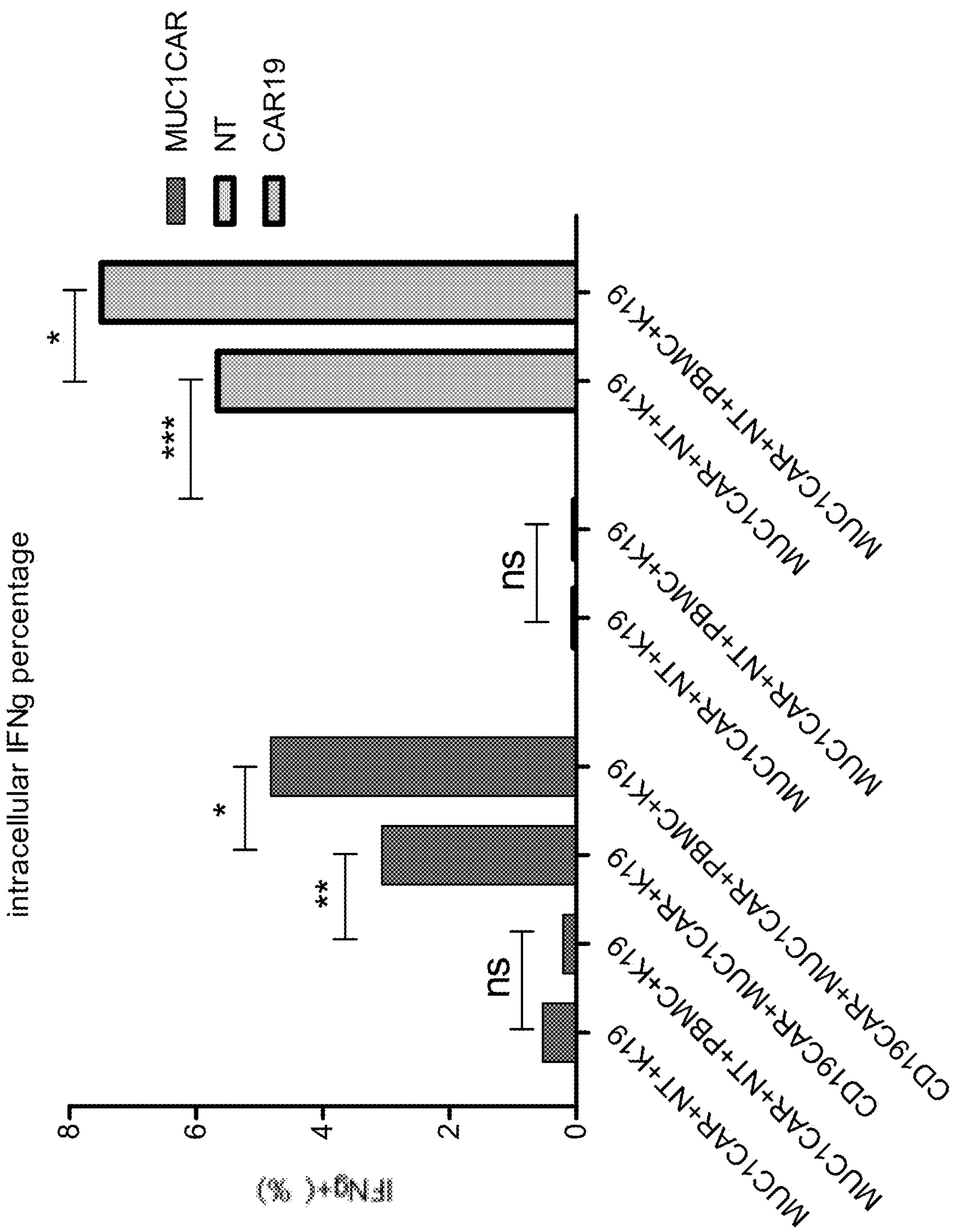
FIG. 38 shows IFNγ release by tMUC1 CAR T cells and CD19 CAR T cells.

FIG. 38 provides a histogram showing IFNγ release by tMUC1 CAR T cells and CD19 CAR T cells. Various cells were cultured on Day 7, and flow cytometry assays were performed on Day 8. The graph is a statistical analysis of the convective graph. In these assays, NT (non-transfected T cells) was used as a control. Compared with the control, cell cultures including CD19 CAR T cells and tMUC1 CAR T cells showed an increase of intracellular IFNγ in CD19 CAR T and MUC1 CAR T cells, indicating that CD19CAR T cells activated by K19 released IFNγ and activated tMUC1CAR T cells to release IFNγ. The PBMC group up-regulated the ratio of IFNγ released by CD19CAR T cells and by tMUC1CAR T cells. IFNγ cumulated in the coupled CAR group was more than that in the cells expressing a single CAR (CD19 CAR or tMUC1 CAR), and the addition of PBMC upregulated this effect. The mCAR-group is not all CD19 CAR positive cells, and the statistical value is relative. The results show that activation of CD19 CAR T cells induced tMUC1 CAR T cells to express more IFNγ and thus release IFNγ in the absence of the antigen that tMUC1 CAR binds (tMUC1).

Figure 39:
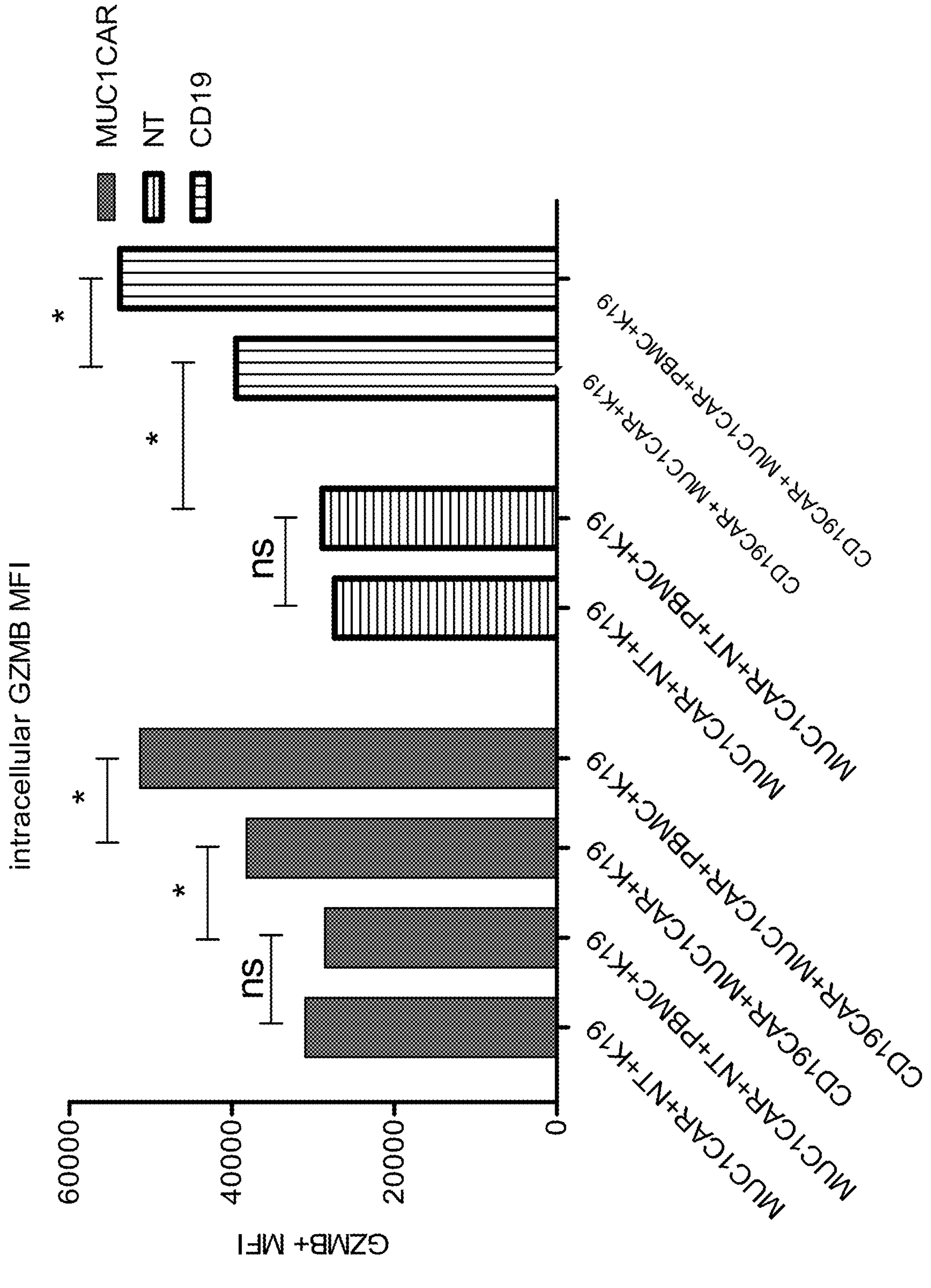
FIG. 39 shows GZMB release by tMUC1CAR T cells and CD19 CAR T cells.

FIG. 39 provides a histogram showing GZMB release by tMUC1 CAR T cells and CD19 CAR T cells. Various cells were cultured on Day 7, and flow cytometry assays were performed on Day 8. Flow cytometry assays showed GZMB release by the activated CD19 CAR T cells and MUC1 CAR T cells. The statistical analysis of the convective graphs (proportional comparison MFI) indicates that the activation of CD19 CAR T cells can cause MUC1 CAR T cells to release GZMB, and such release was enhanced in the presence of PBMC. The mCAR-group is not all CD19 CAR positive cells, and the statistical value is relative. These results show that activation of CD19 CAR T cells induced MUC1 CAR T cells to release intracellular GZMB.

Figure 40:
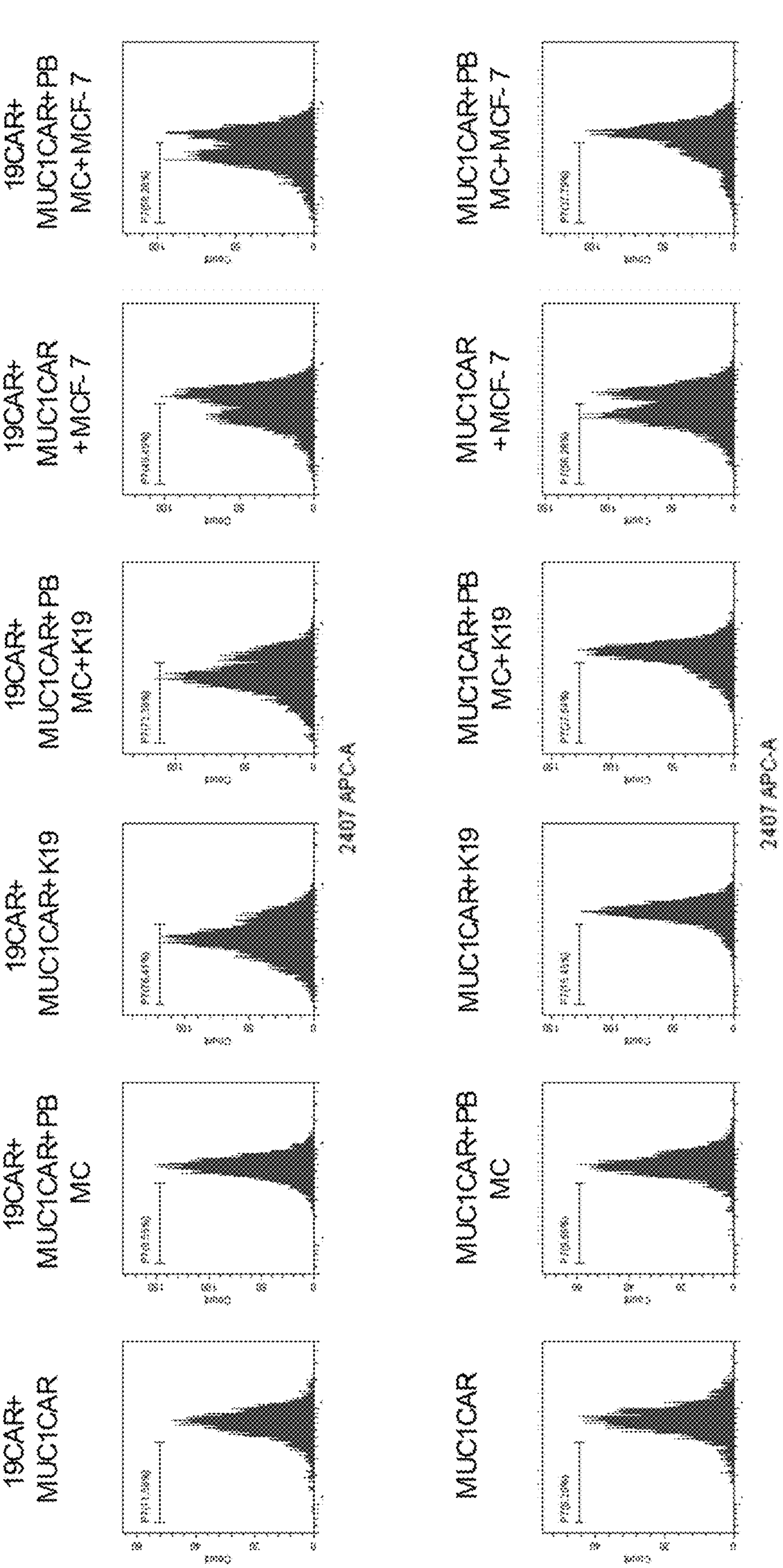
FIGS. 40 and 41 show proliferation of MUC1CAR T cells in various embodiments.
Figure 41:
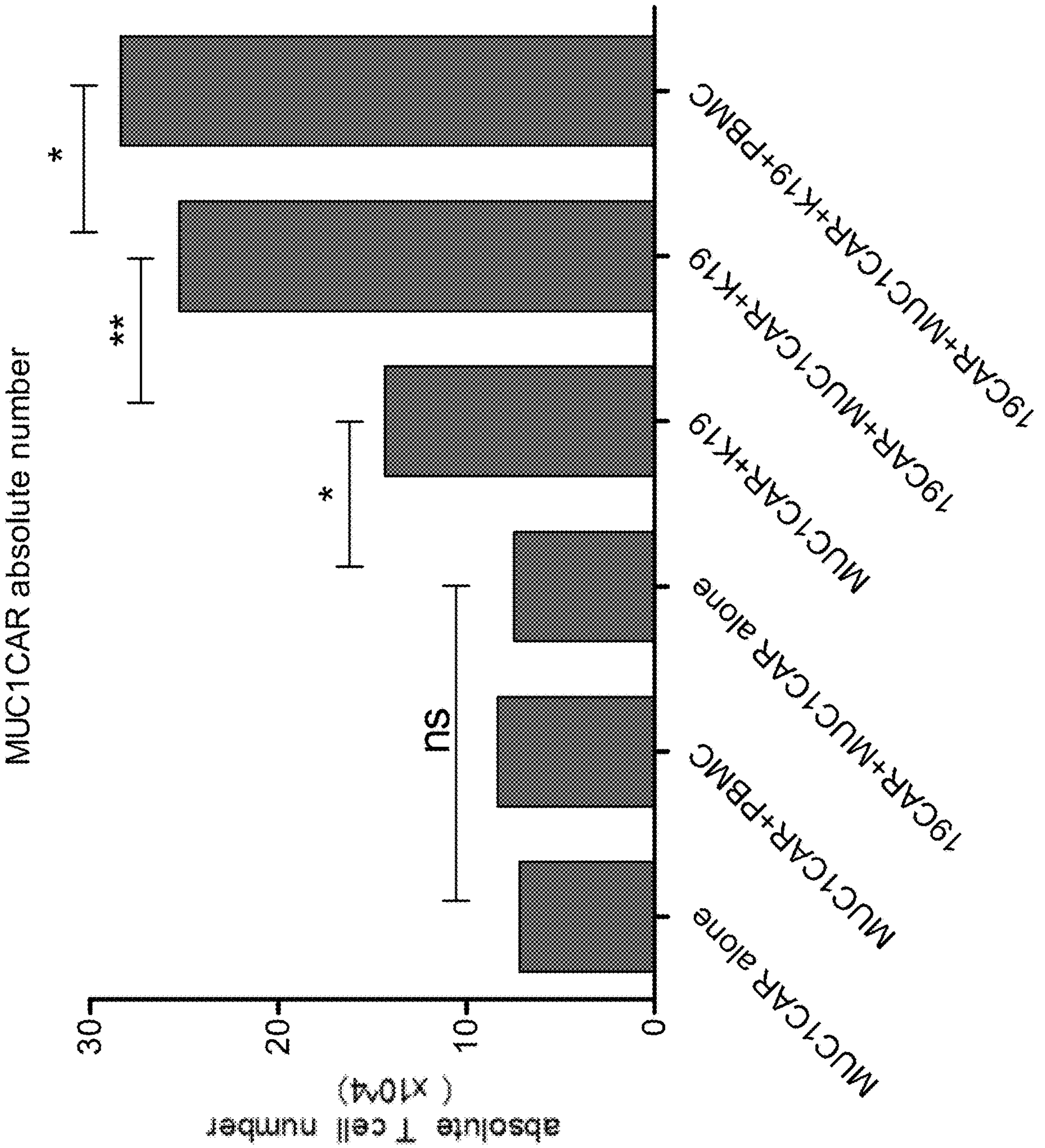
Figure 42:
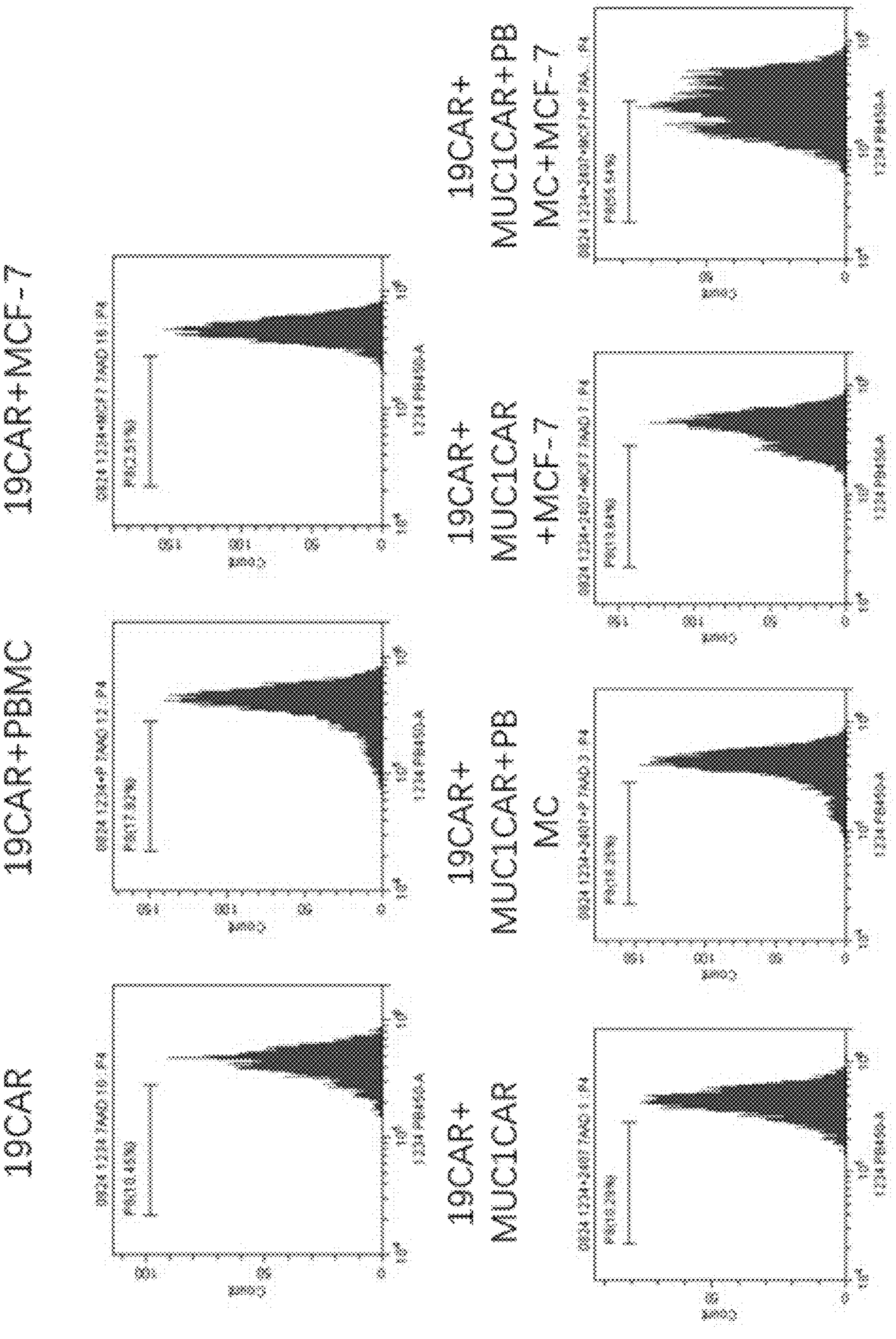
FIG. 42 shows proliferation of CD19 CAR T cells in various embodiments.

FIGS. 40 and 41 show proliferation of MUC1 CAR T cells in various embodiments. CFSE reactions were performed and used to indicate levels of cell proliferation. Various cells were cultured on Day 7, and flow cytometry assays were performed on Day 8. As shown on FIG. 40, the first row is the experimental group of coupled CAR T cells co-cultured with two substrate cells, and the second row is the control group of MUC1 CAR T cells co-cultured with two substrate cells. As shown in the third and fourth columns of the first and second rows, activation of CD19 CAR T cells with K19 induces the proliferation of MUC1 CAR T cells. The fifth and sixth columns show that MCF-7 activates and incudes the proliferation of MUC1CAR T cells. FIG. 41 shows counting results from the flow cytometry shown in FIG. 40. The volume calibration was performed, tMUC1 CAR cell population was gated, and the number of cells of each group of tMUC1 CAR was statistically analyzed. As shown in FIG. 41, the number of cells in the group including CD19 CAR T cells and tMUC1CAR T cells was higher than that in the control group, and the proliferation of the group including CD19 CAR T cells and tMUC1 CAR T cells in the presence of PBMC was the highest. The results show that activation of CD19 CAR T cells can enhance the proliferation of MUC1 CAR T cells, which can be enhanced and/or medicated through PBMC.

FIG. 12 shows the proliferation CD19 CART cells in various embodiments. CFSE reactions were performed and used to indicate levels of cell proliferation. Various cells were cultured on Day 7, and flow cytometry assays were performed on Day 8. The groups of cells comprising CD19 CAR T cells, tMUC1 CAR T cells, MCF-7 in the presence or absence of PBMC showed the proliferation of CD19 CAR T cells. These results show that activation of tMUC1 CAR T cells can enhance the proliferation of CD19 CAR T cells, which may be enhanced and/or medicated through PBMC. The combination of the results shown in FIGS. 40-42 indicates that the mixture of CD19 CAR T cells and tMUC1 CAR T cells may form a positive circle through PBMC such that activation of CD19 CAR T cells or tMUC1 CAR T cells may further activate each other to enhance the proliferation of CD19 CAR T cells and tMUC1 CAR T cells and/or the release of cytokines by CD19 CAR T cells and tMUC1 CAR T cells, which may be mediated and/or enhanced by PBMC (See FIG. 62). These results can also explain the reason that tMUC1 CAR T cells expanded more in subjects infused with a population of cells comprising coupled CAR T cells (e.g., Patients 001-003) than subjects infused with a population of cells including a single type of CAR T cells (e.g., Patient 004-010). Coupled CAR T cells (e.g., CD19 CAR T cells and tMUC1 CAR T cells) can contribute to this enhanced cell expansion.

Figure 43:
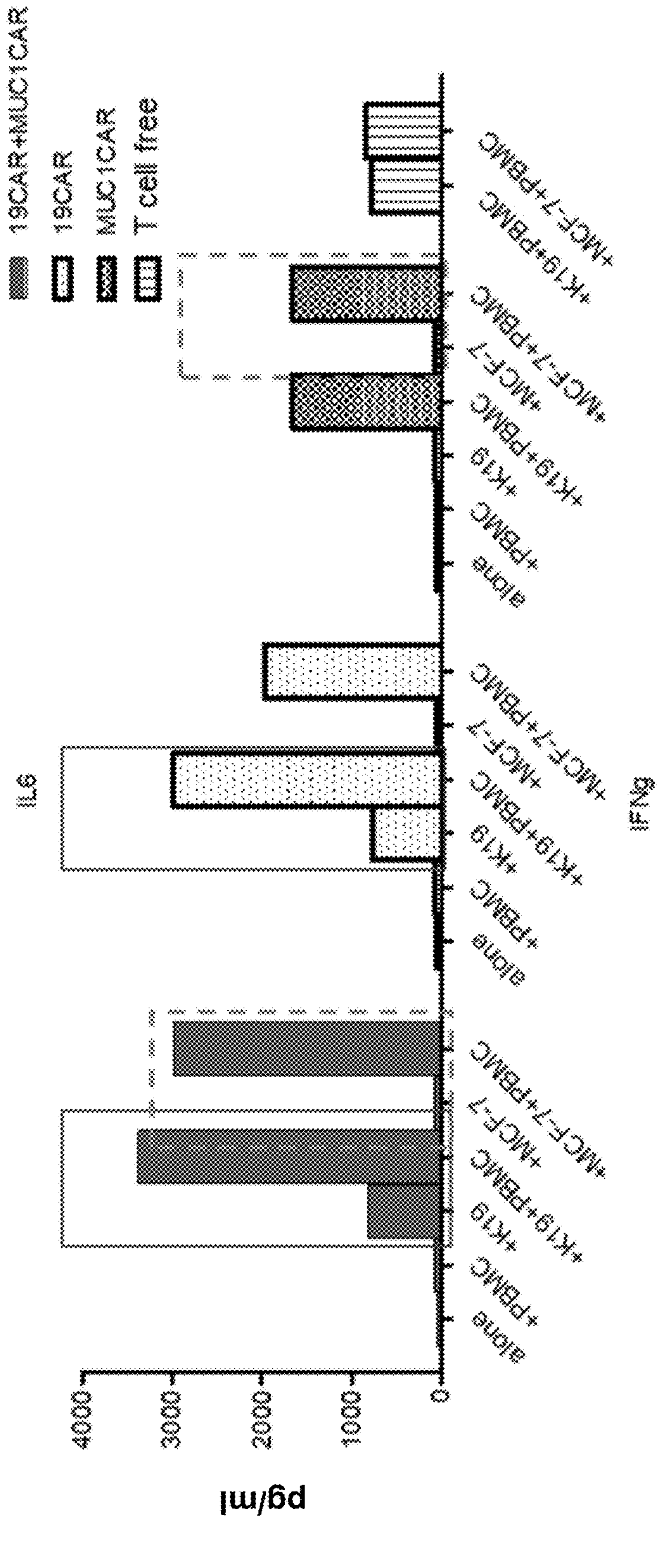
FIG. 43 shows cytokine releases in embodiments.
Figure 43:
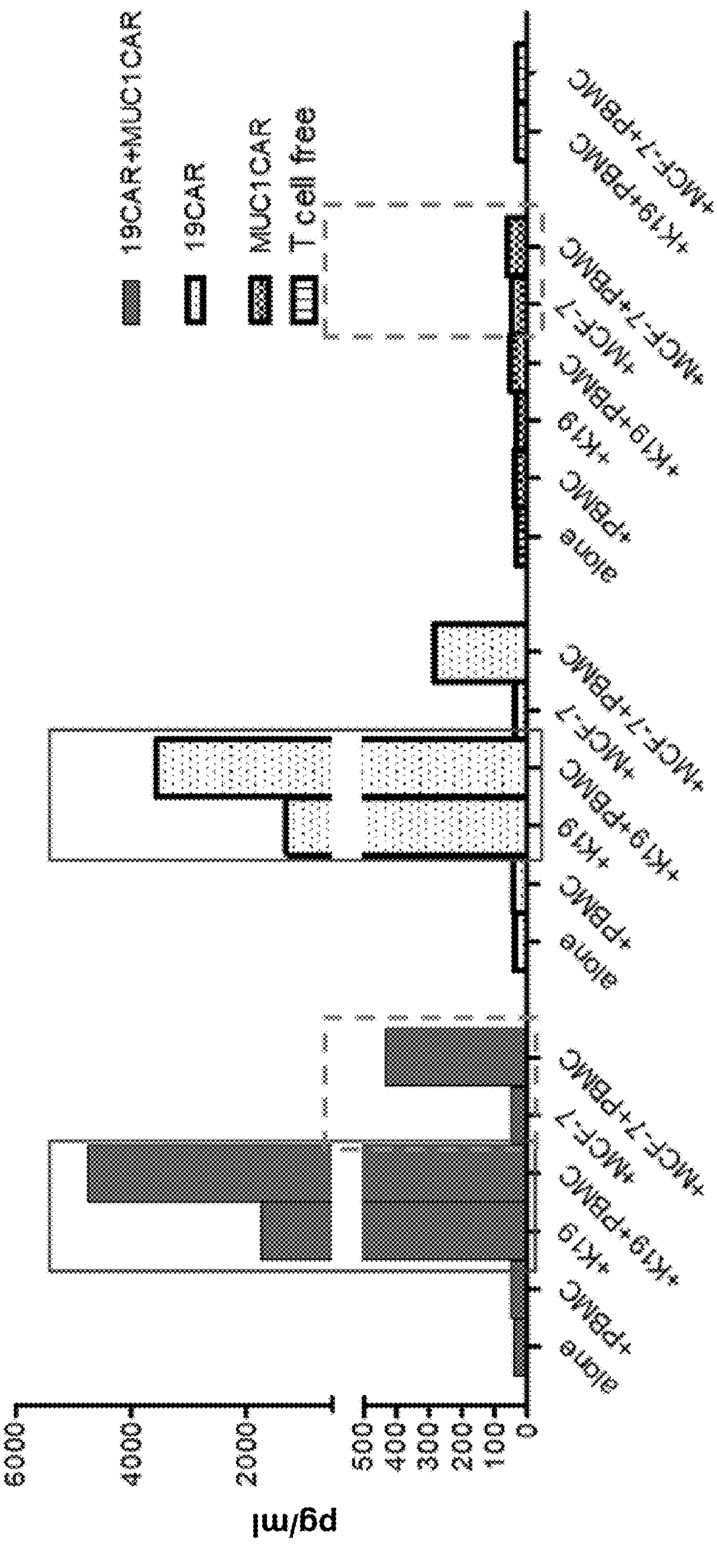

FIG. 43 shows cytokine release in embodiments. Various cells were cultured on Day 7, and flow cytometry assays were performed on Day 8. As shown in FIG. 43, IFN-γ release in the control group is limited. The coupled CAR group and single CAR group are labeled using the solid line and the dotted line, respectively. The levels of IFN-γ released were similar in the absence of PBMC. When PBMC was added, the levels of IFN-γ released increased. IL6 was mainly secreted by PBMC, and the released amount in the activated system is increased. Here, the amount of tMUC1CAR cytokine released was relatively low.

TABLE 12

CAR T cells and substrate cells used in Group 2

| | CD19 CAR T cells & ACPP CAR cells | | |
|---|---|---|---|
| Coupled CAR T cells CART Cell ID | CAR | Substrate Cell | Notes |
| 1234 | CD19 CAR | Nalm | CD19 positive Cell |
| 6503 | ACPP CAR | PC3-ACPP | ACPP positive cell |

Figure 44:
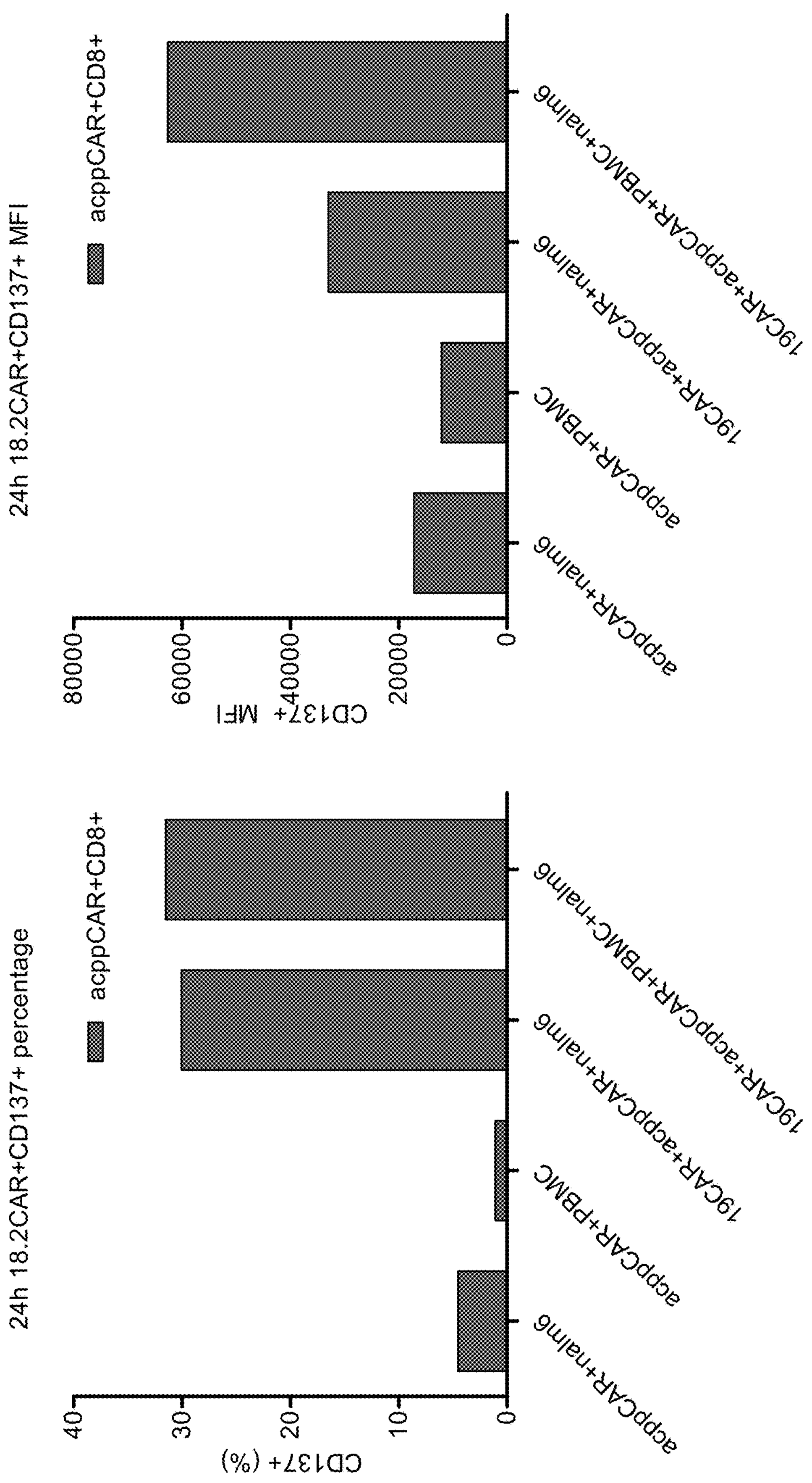
FIG. 44 shows CD137 expression in various cell cultures.

FIG. 44 shows other histograms of CD137 expression in various cell cultures. Peripheral blood of healthy volunteers was collected on Day 0. CD3+ T cells were sorted and collected using Pan T kits, and CD3/CD28 Dynabeads were added at a 1:1 ratio to the collected CD3+ T cells. Day 1, CD3+ T cells were transfected with lentivirus encoding CD19 CAR and ACPP CAR, respectively. The binding domains of CD19 CAR and ACPP CAR include SEQ ID NOs: 5 and 489, respectively. On Day 2, the lentivirus and the Dynabeads were removed, and fresh media were added. On Day 7, CAR T cells and target cells were co-cultured for 24 hours and various assays were performed on Day 8. Flow cytometry assays were performed, and the results show expression of CD19 CAR and ACPP CAR T cells. As shown in FIG. 44, the activation of the ACPP CAR T cells was higher, and the activation was increased in presence of PBMC. These results show activation of CD19 CAR T cells by nalm6 can activate ACPP CAR T cells, and this effect is enhanced by PBMC.

Figure 45:
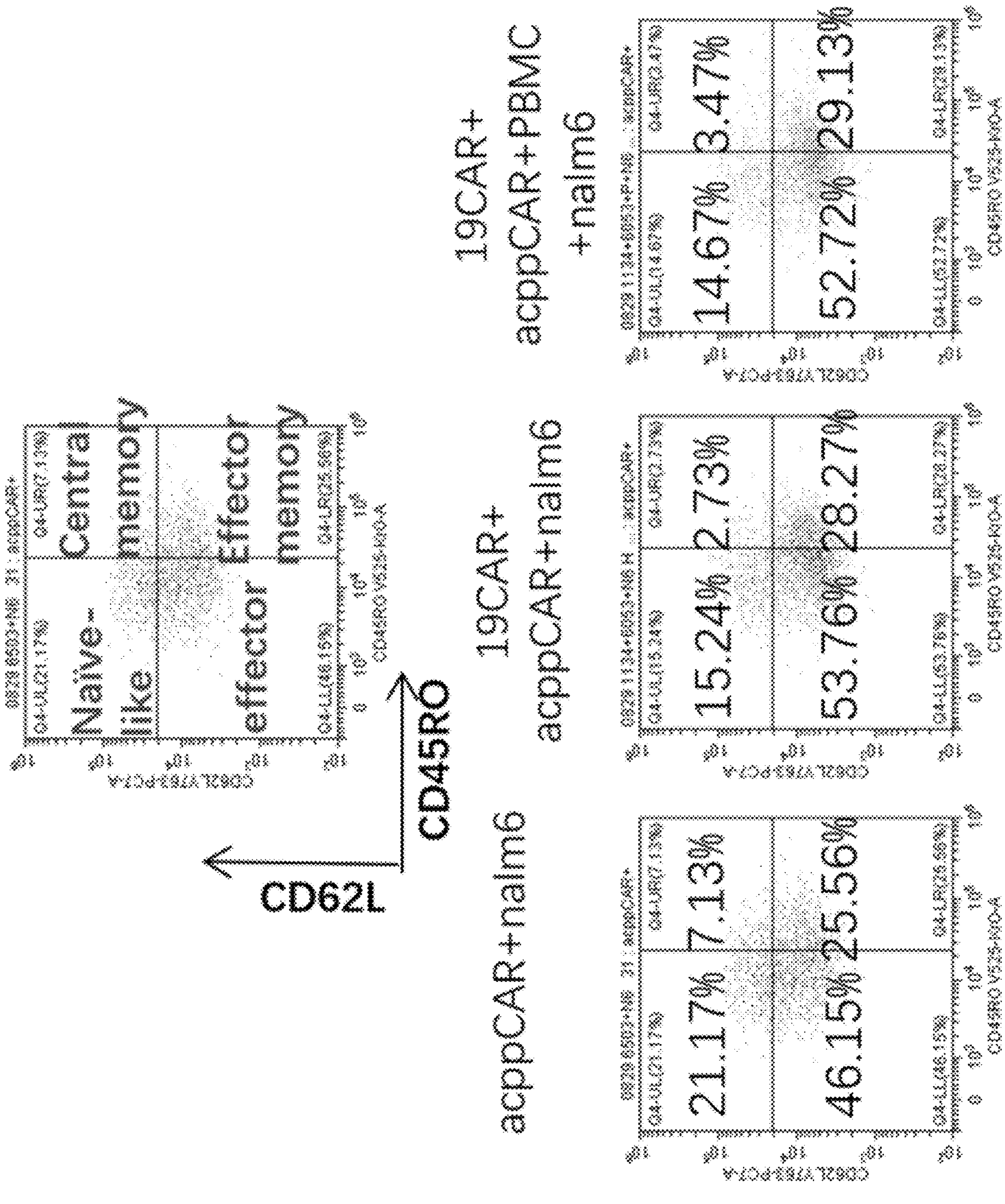
FIG. 45 shows results of flow cytometry analysis of cell activation.

FIG. 45 shows flow cytometry assays of activation analysis. CD45RO and CD62L can be used to divide CART cells into four states. Nalm6 activated expression of CD45RO and CD62L on CD19 CAR T cells, and the proportion of effector cells in ACPP CAR T cells increased. These results show that the activation of CD19 CAR T cells induced ACPP CAR T cells to a functional state, which acted as the pre-activation of ACPP CAR T cells.

Figure 46:
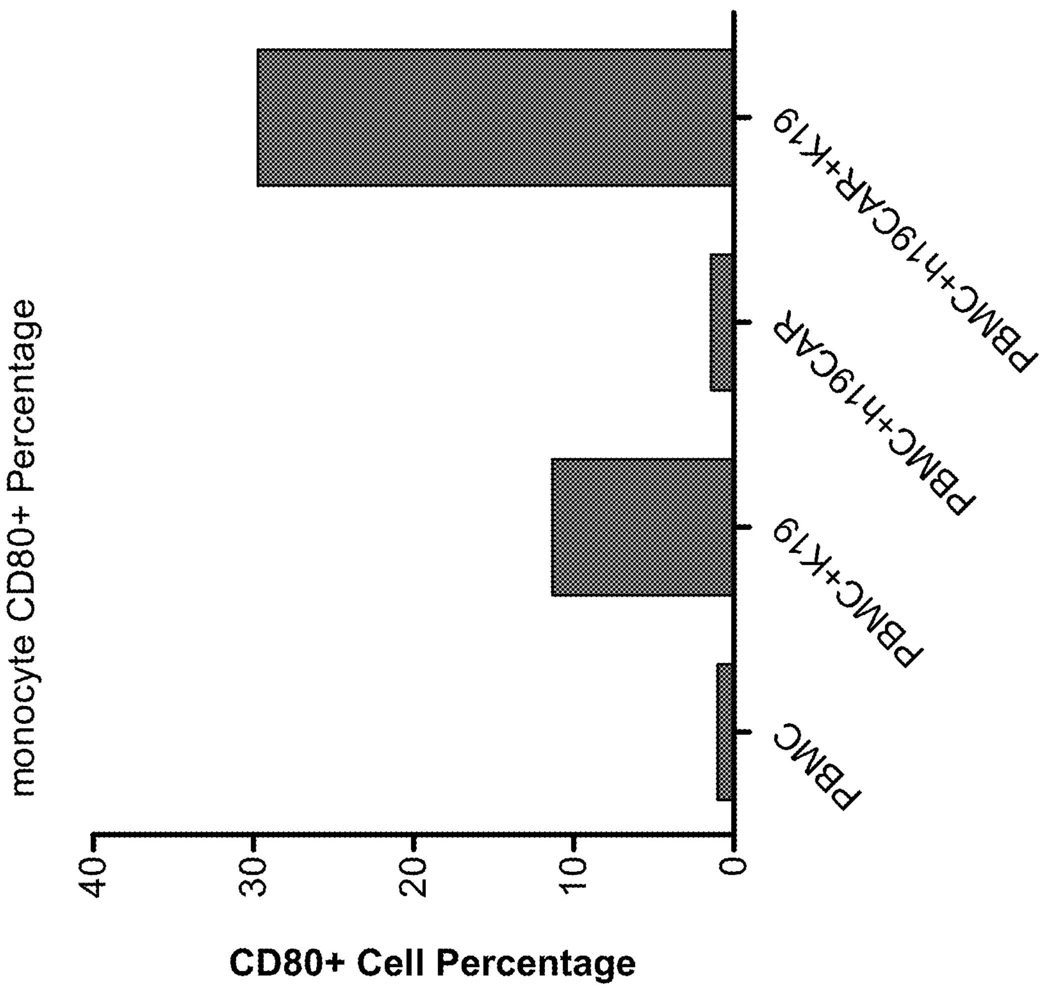
FIG. 46 shows the activation of PBMC and monocyte in the cell cultures described in FIG. 44.

FIG. 46 shows the activation of PBMC and monocyte in the cell cultures described in FIG. 44. Flow cytometry assays showed monocyte (CD14+) and activated monocyte (CD14+&CD80+) in PBMC. h19CAR is a humanized CD19CAR, and the groups include (1) PBMC alone, (2) PBMC and K19, (3) PBMC andCD19CAR T cells, (4) PBMC and K19 and CD19CAR T cells. These results indicate that activation the CAR T cells is capable of activating PBMC.

Figure 47:
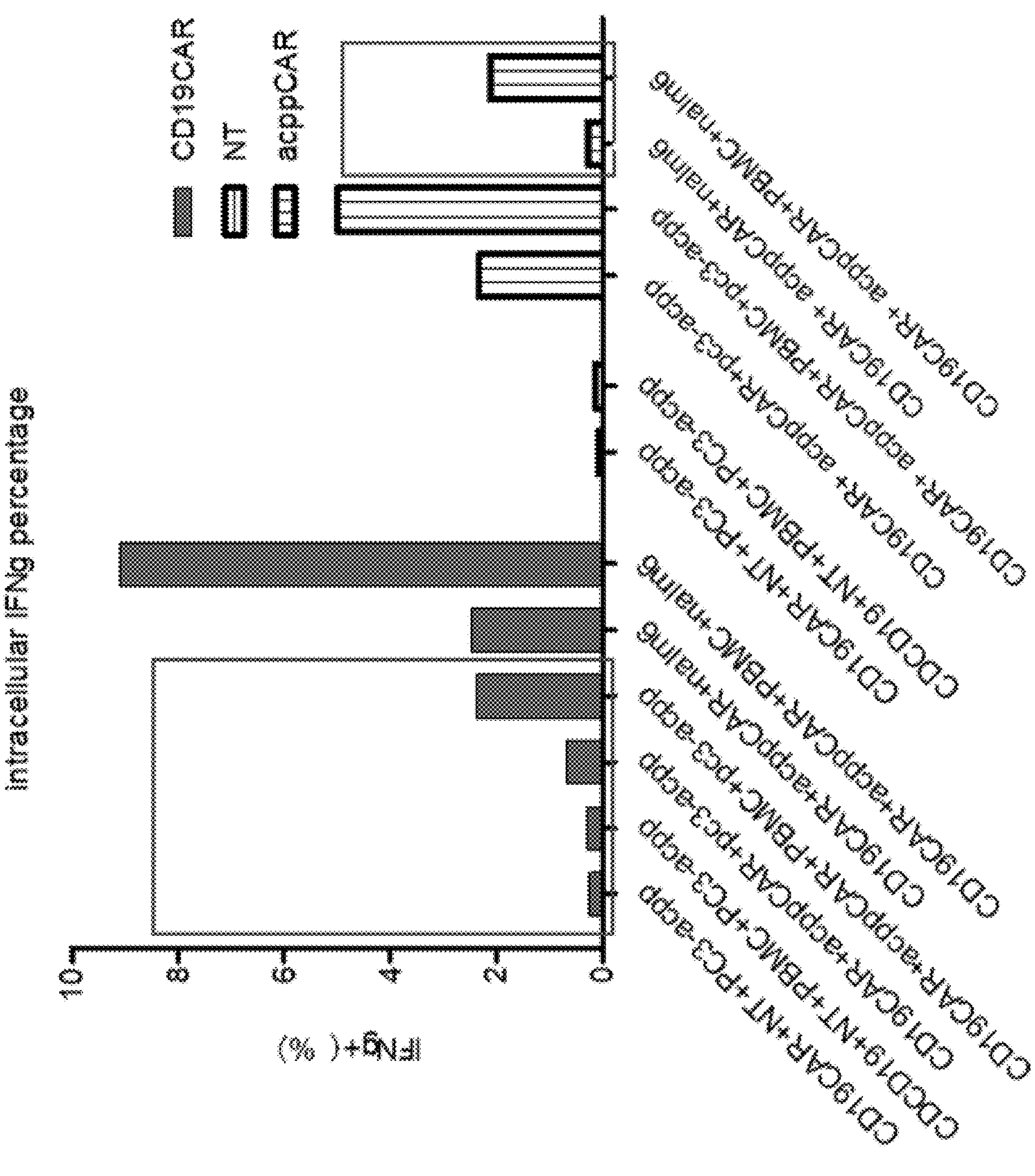
FIG. 47 shows that activation of CD19 CAR T cells causes ACPP CAR T cells to release intracellular IFNγ.

FIG. 47 shows that activation of CD19 CAR T cells induces ACPP CAR T cells to release intracellular IFNγ. Similar to above, various cells were cultured on Day 7, and flow cytometry assays were performed on Day 8. When both CAR T cells were present and there was PBMC in the system, ACPP CAR T cells also showed enhanced IFNγ release.

Figure 48:
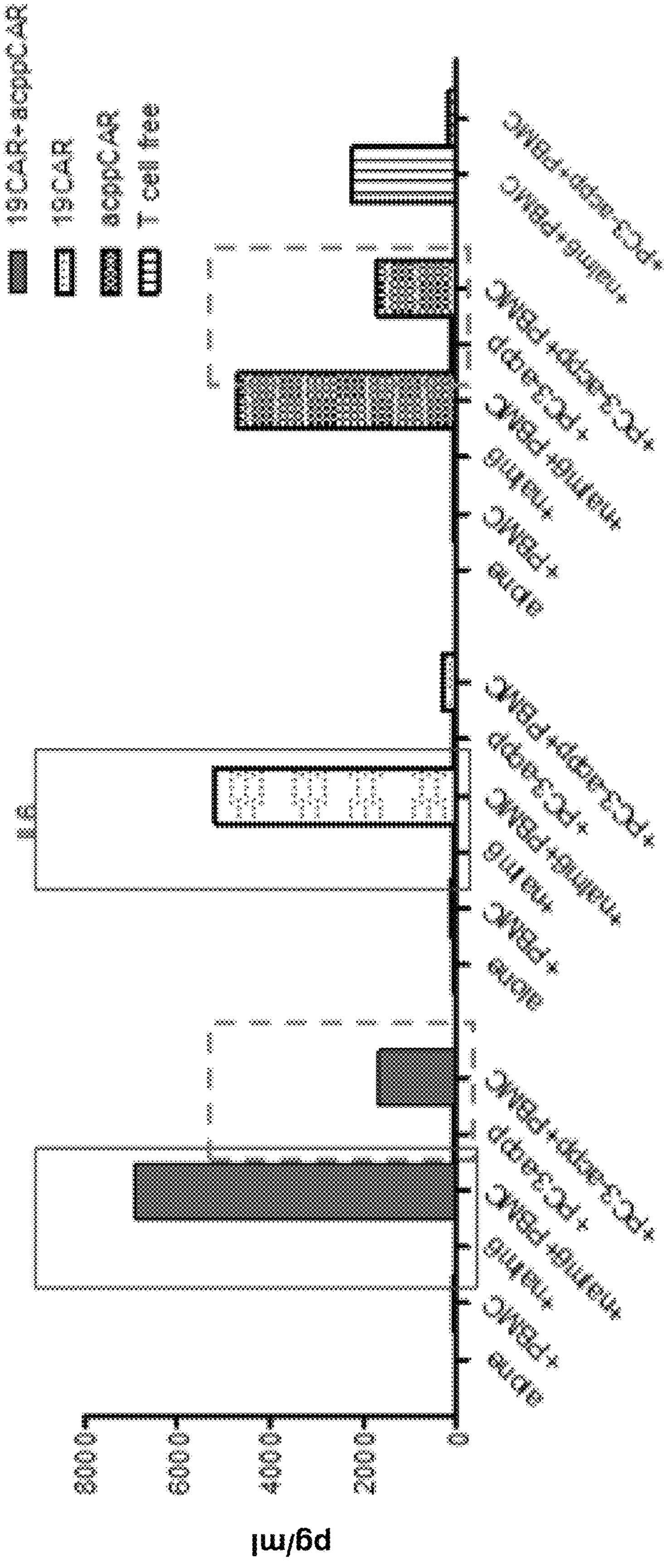
FIGS. 48 and 49 show cytokine releases after cells are co-cultured for 24 hours (hrs) in cell cultures.
Figure 48:
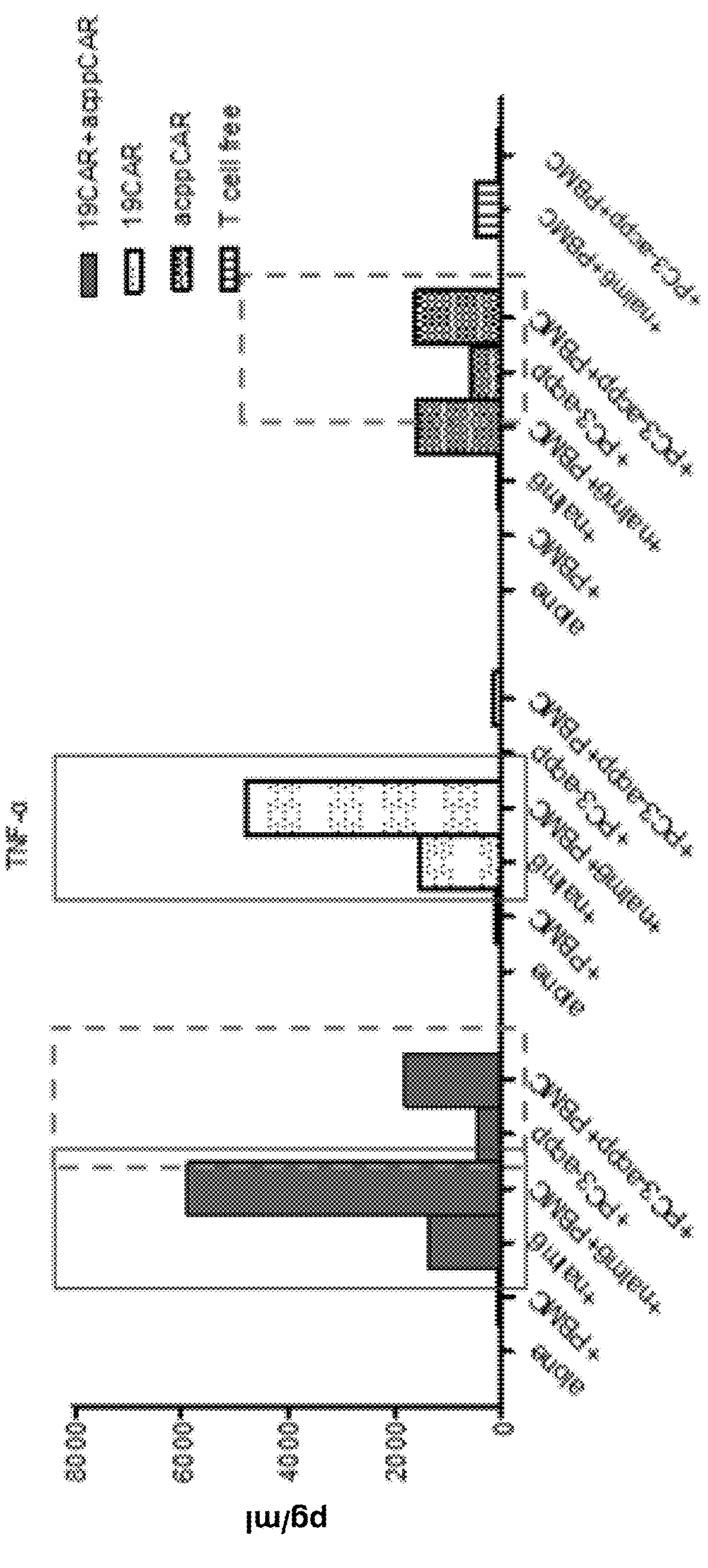
Figure 49:
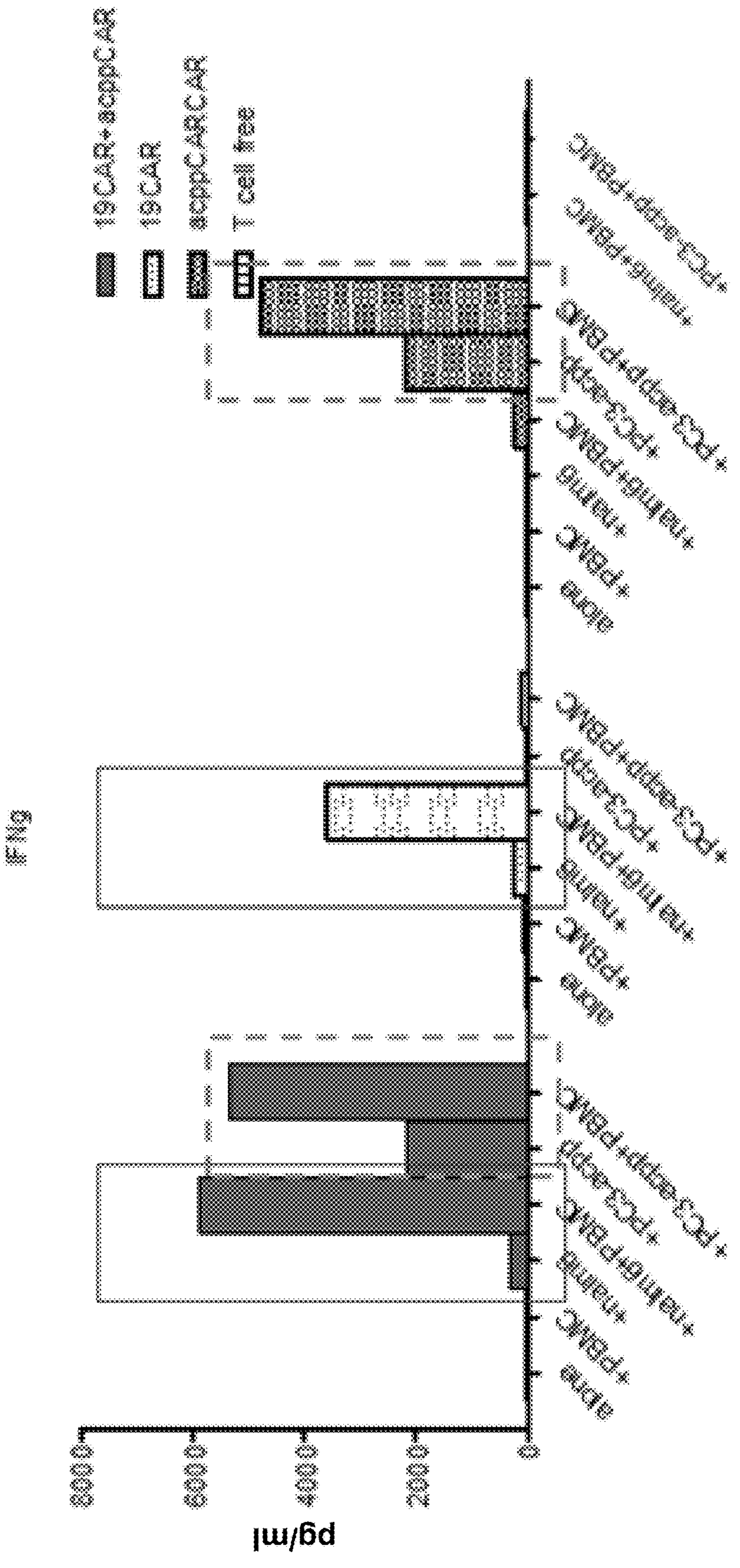
Figure 49:
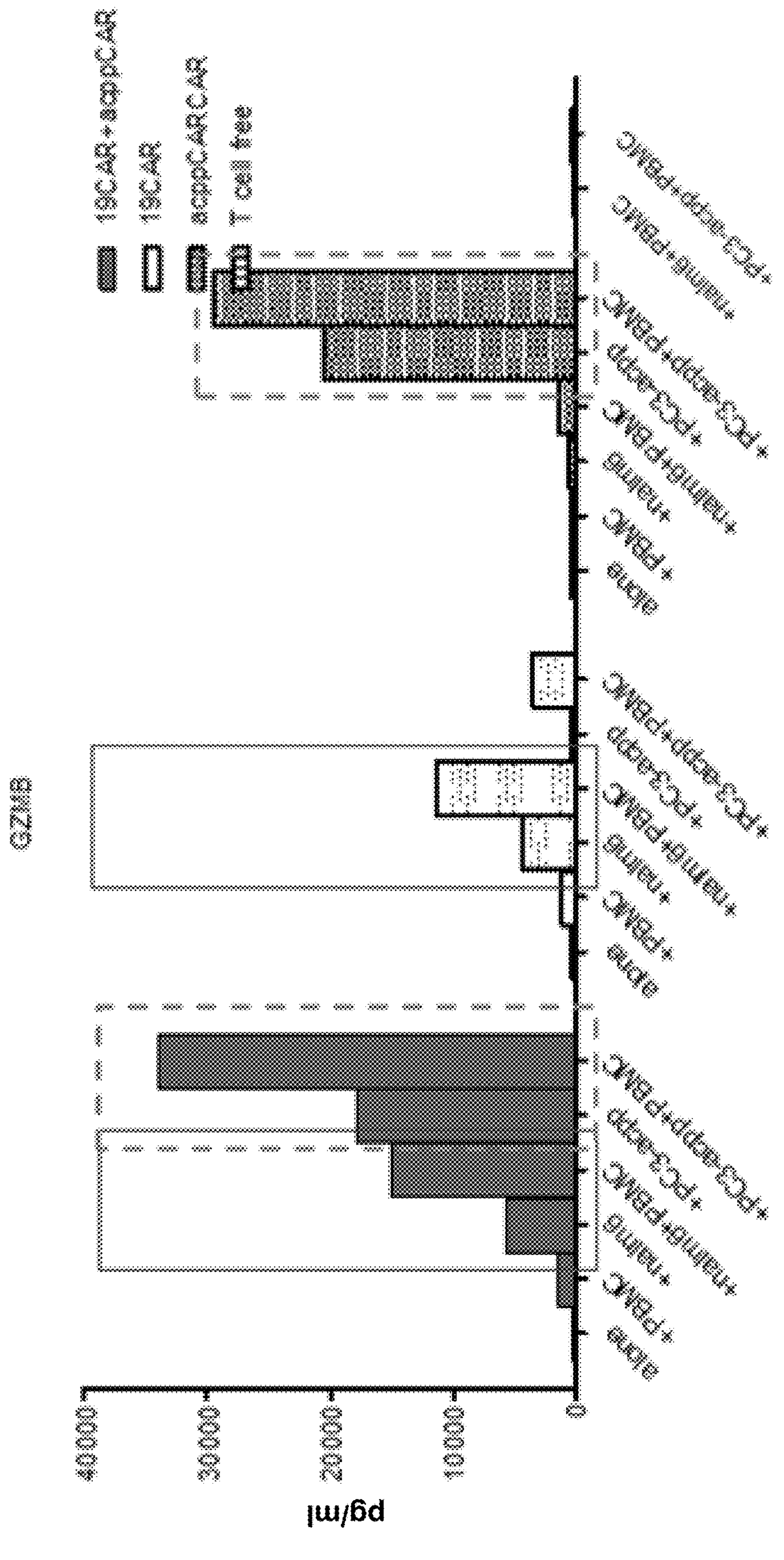

FIGS. 48 and 49 show cytokine release after cells were co-cultured for 24 hrs in cell cultures. There are limited amounts of TNF-α, IFN-γ, GZMB released in the control group. The coupled CAR group (CD19 CAR T cells and ACPP CAR T cells) and single CAR group (CD19 CAR T cells or ACPP CAR T cells) were labeled with solid line and dotted line, respectively. The levels of TNF-α, IFN-γ, GZMB released are similar in the absence of PBMC. When PBMC was added, the amount of TNF-α, IFN-γ, GZMB released increased. IL6 was mainly secreted by PBMC, and the amount of released cytokines was enhanced in the coupled CAR group in the presence of PBMC.

TABLE 13

CAR T cells and substrate cells used in Group 3

| | CD19 CAR T cells & CLDN 18.2 CAR T cells | | |
|---|---|---|---|
| Coupled CAR T cells CART Cell ID | CAR | Substrate Cell | Note |
| 1234 | CD19 CAR | K19 | CD19 positive Cell |
| 6503 | CLDN 18.2 CAR | KATO3 | CLDN 18.2 positive cell |

Figure 50:
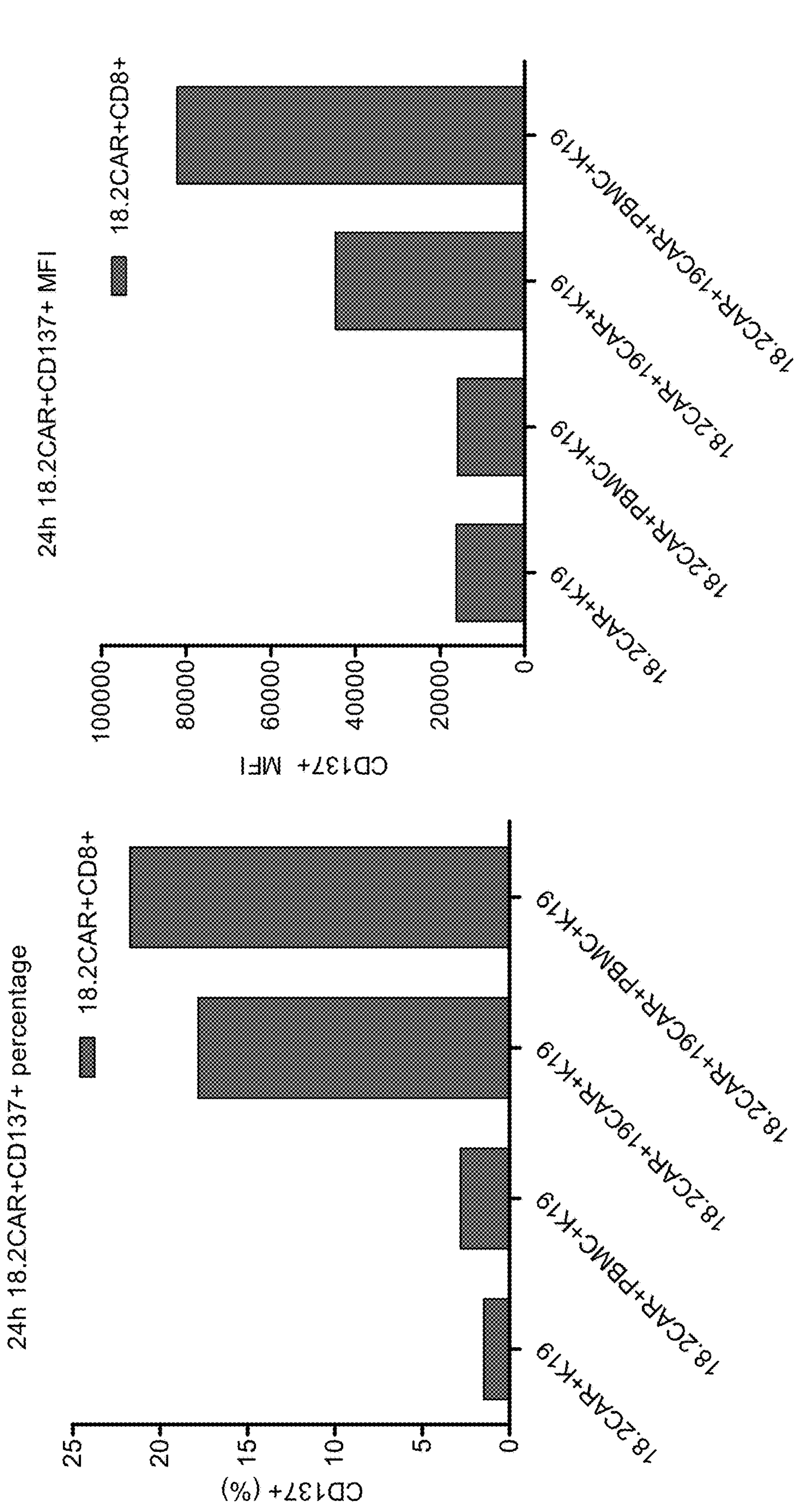
FIG. 50 shows CD137 expression in various cell cultures.

FIG. 50 provides additional histograms showing CD137 expression in various cell cultures. Peripheral blood of healthy volunteers was collected on Day 0. CD3+ T cells were sorted using Pan T kits, and CD3/CD28 Dynabeads were added at a 1:1 ratio. On Day 1, CD3+ T cells were transfected with lentivirus encoding CD19 CAR and CLDN 18.2 CAR, respectively. The binding domains of CD19 CAR and CLDN 18.2 CAR include SEQ ID NOs: 5 and 437, respectively. On Day 2, the lentivirus and the Dynabeads were removed, and fresh media were added. On Day 7, CAR T cells and target cells were cocultured for 24 or 48 hours and various assays were performed on Day 8. As shown in FIG. 50, the activation of the CLDN18.2 CAR T cells was higher, and the activation was enhanced in the presence of PBMC. These results show that activation of CD19 CAR T cells by K19 can indirectly activate CLDN18.2 CAR T cells, and this effect is enhanced by PBMC.

Figure 51:
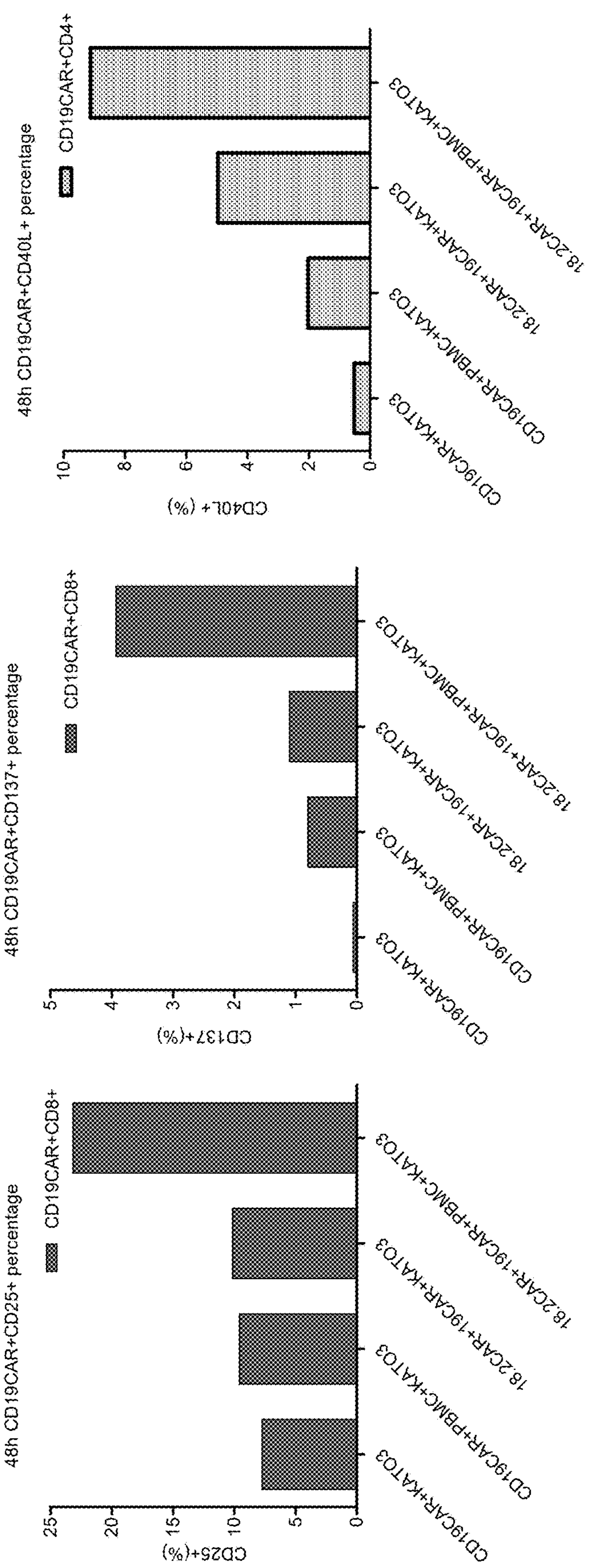
FIG. 51 shows results of flow cytometry analysis of various CAR T cells co-cultured with KATO3+ cells for 48 hours.

FIG. 51 shows results of flow cytometry analysis of various CAR T cells cocultured with KATO3+ cells for 48 hours. It can be seen from the histograms that the level of activation of CD19 CAR T cells in the coupled CAR T group (CD19 CAR T cells and CLDN 18.2 CAR) was higher than in the single CAR T group (CD19 CAR T cells or CLDN 18.2 CAR) in the presence of KATO3+ cells. The level of activation of CD19 CAR T cells was higher after being activated in the presence of PBMC (e.g., the ratio of CD25 and CD137), indicating that CD19 CAR T cells can be activated by activation of CLDN18.2 CAR T cells by KATO3+ cells, which was enhanced by PBMC. CD40L is mainly expressed by CD4 T cells (interacting with CD40L+ cells in PBMC, such as B cells, activated monocytes, DC). The results show that activation of CLDN18.2 CAR T cells by KATO3+ cells can up-regulate the expression of CD40L of CD19 CAR T cells, which can activate B cells and mononuclear cells. This effect was enhanced by PBMC.

Figure 52:
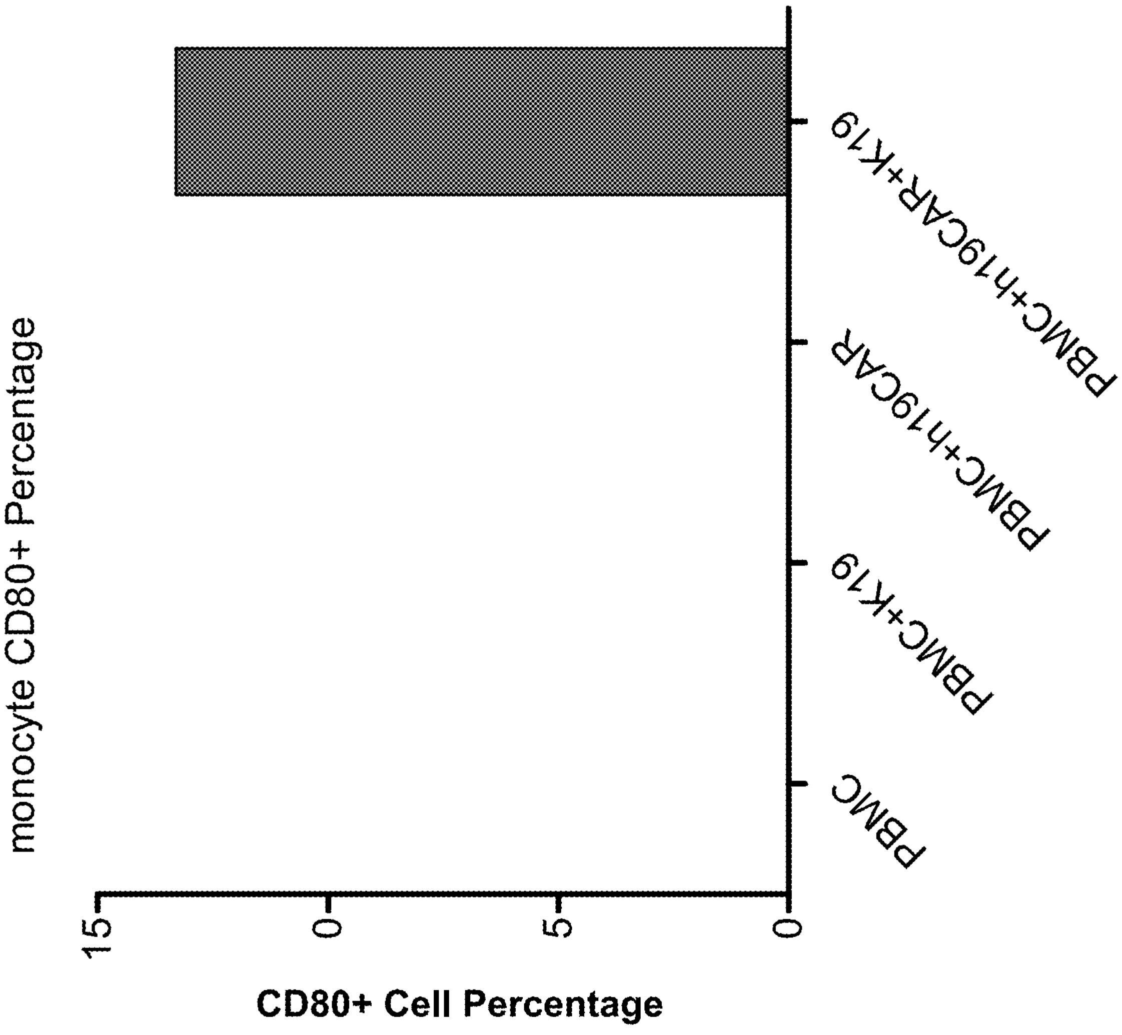
FIG. 52 shows the activation of PBMC and monocyte in the systems described in FIG. 50.

FIG. 52 shows the activation of PBMC and monocyte in the systems described in FIG. 50. h19CAR is a humanized CD19 CAR, and the groups include (1) PBMC alone, (2) PBMC and K19, (3) PBMC and CD19 CAR T cells, (4) PBMC, K19, and CD19 CAR T cells. As shown in FIG. 52, last column of PBMCs shows activation, indicating that activation of the CAR T cells is capable of activating PBMC.

Figure 53:
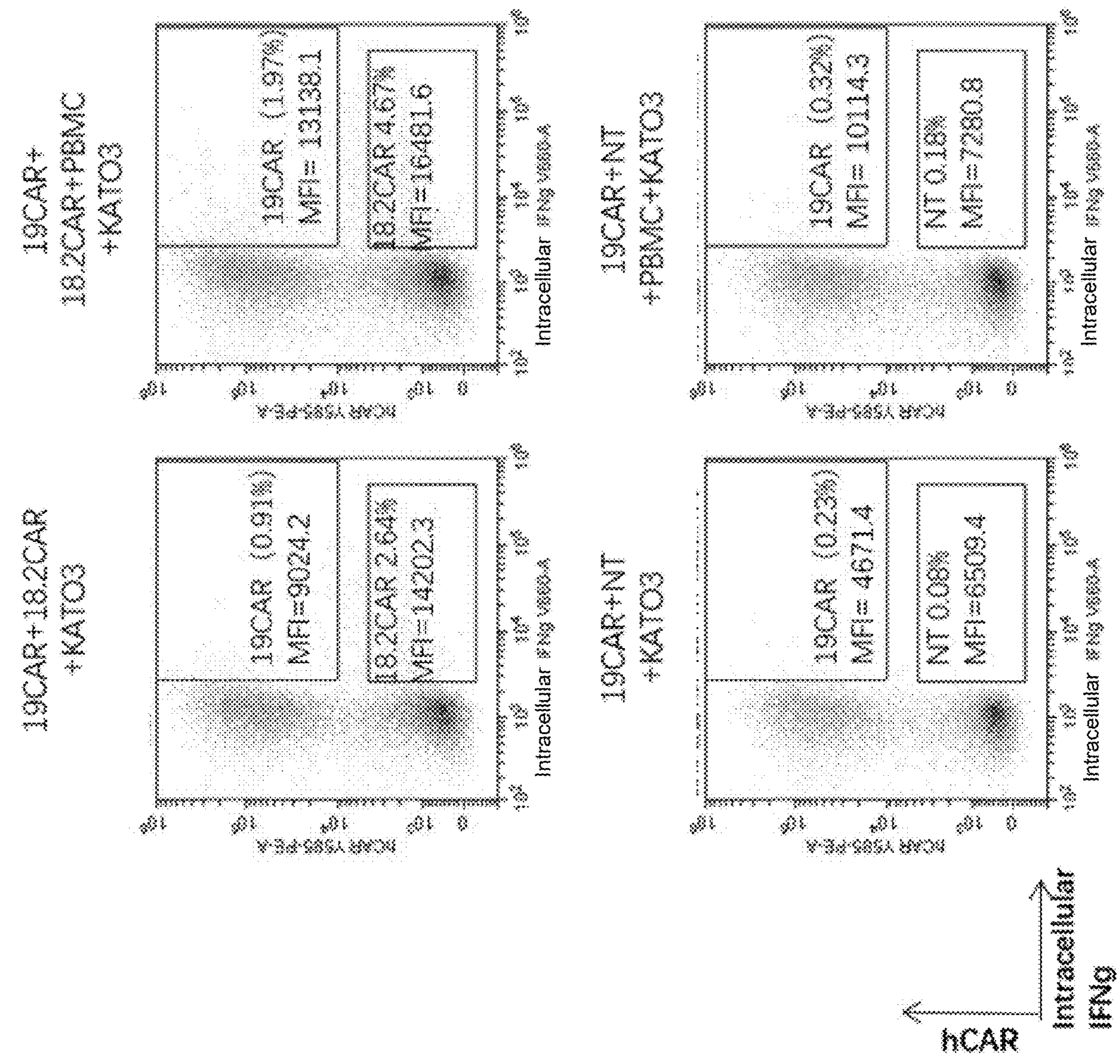
FIGS. 53 and 54 show activation of CLDN18.2 CAR T cells causes CD19 CAR T cells to release intracellular IFNγ.
Figure 54:
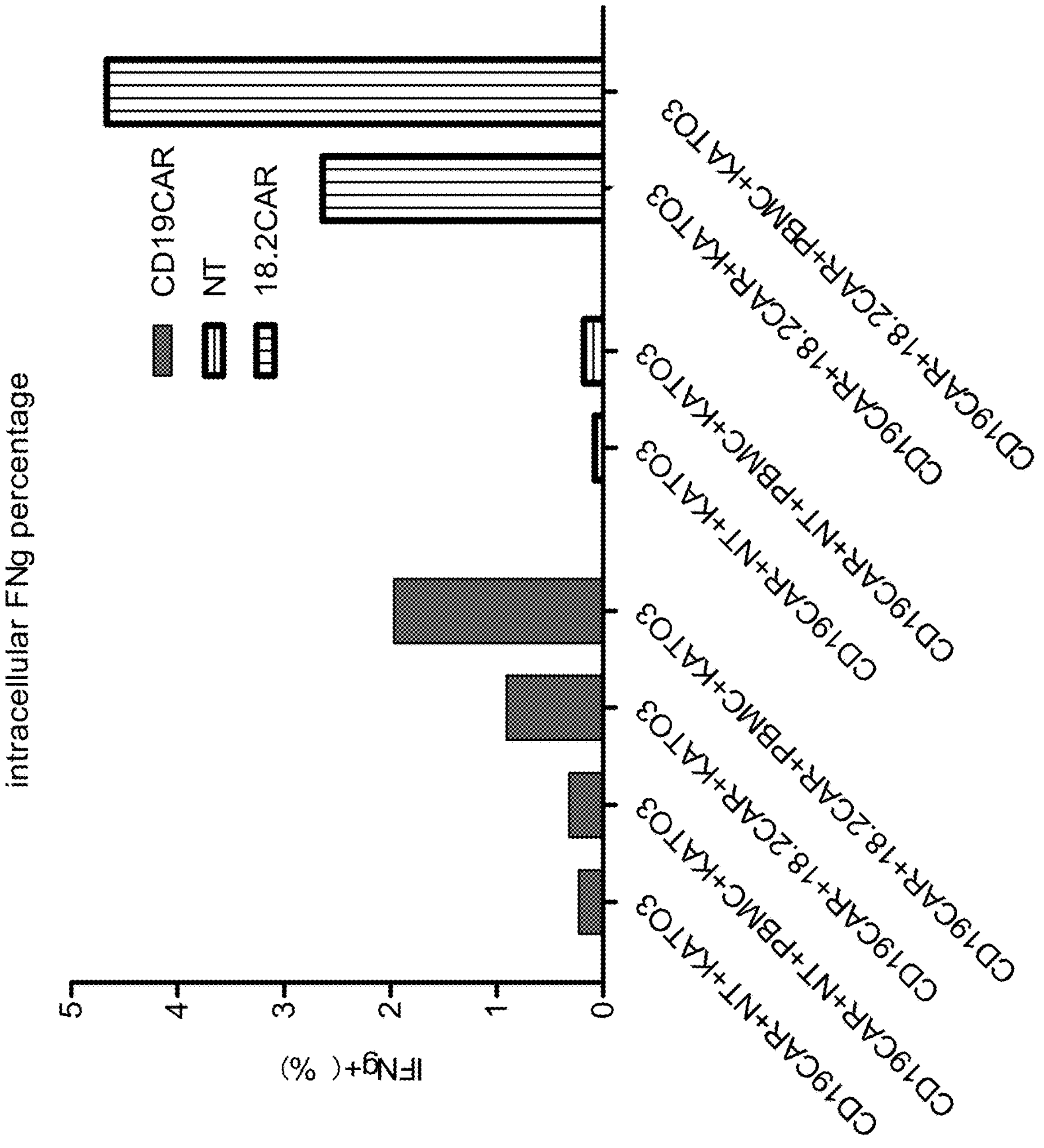

FIGS. 53 and 54 show that activation of CLDN18.2 CAR T cells induces CD19 CAR T cells to release intracellular IFNγ. Similar to those in FIGS. 39 and 39, the amount of IFNγ released in the coupled CAR T cell group (CD19 CAR T cells and CLDN 18.2 CAR) was more than that of the single type CAR T cell group (CD19 CAR T cells or CLDN 18.2 CAR), and the addition of PBMC can upregulate this effect.

Figure 55:
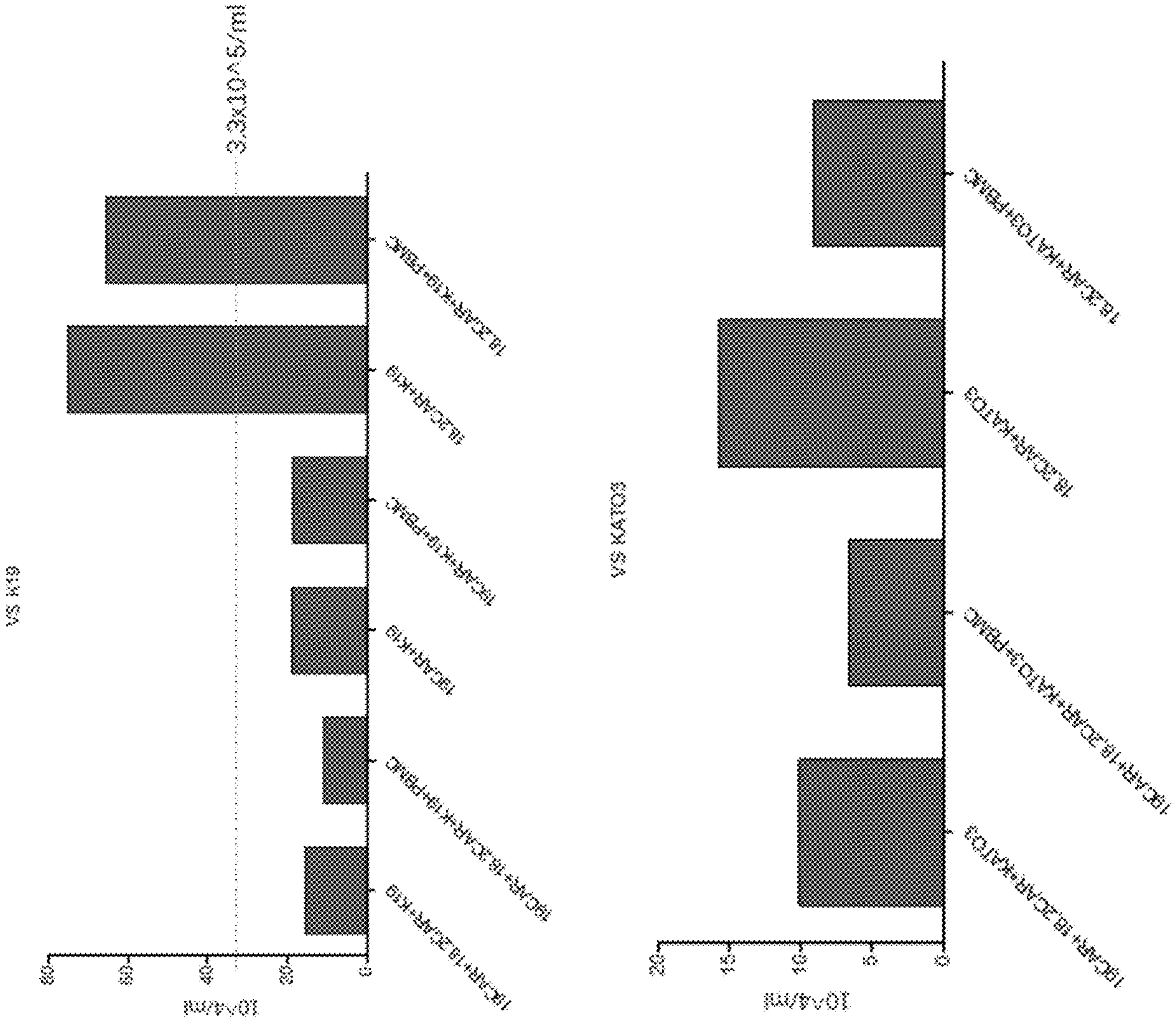
FIG. 55 shows results of killing assays of various cell cultures.

FIG. 55 shows killing assays for various cell cultures. The starting amount of both substrate cells is $2.0\times10^5$/600 ul or $3.33\times10^5$/ml. FIG. 55 shows the cell density of the substrate cells after three days of killing. PBMC helped the killing of the substrate cells, and the coupled CAR T cell group (CD19 CAR T cells and CLDN 18.2 CAR) enhanced the killing effect of CD19 CAR T cells alone or CLDN18.2 CAR T cells alone. In the presence of PBMC, the coupled CAR T cells had better killing effects, demonstrating that the activated CAR T cells can activate PBMC and further activate another type of CAR T cells in the coupled CAR T cell group to release cytokines and enhance the efficacy when a type of CAR T cells in a coupled CAR T system is activated.

Figure 56:
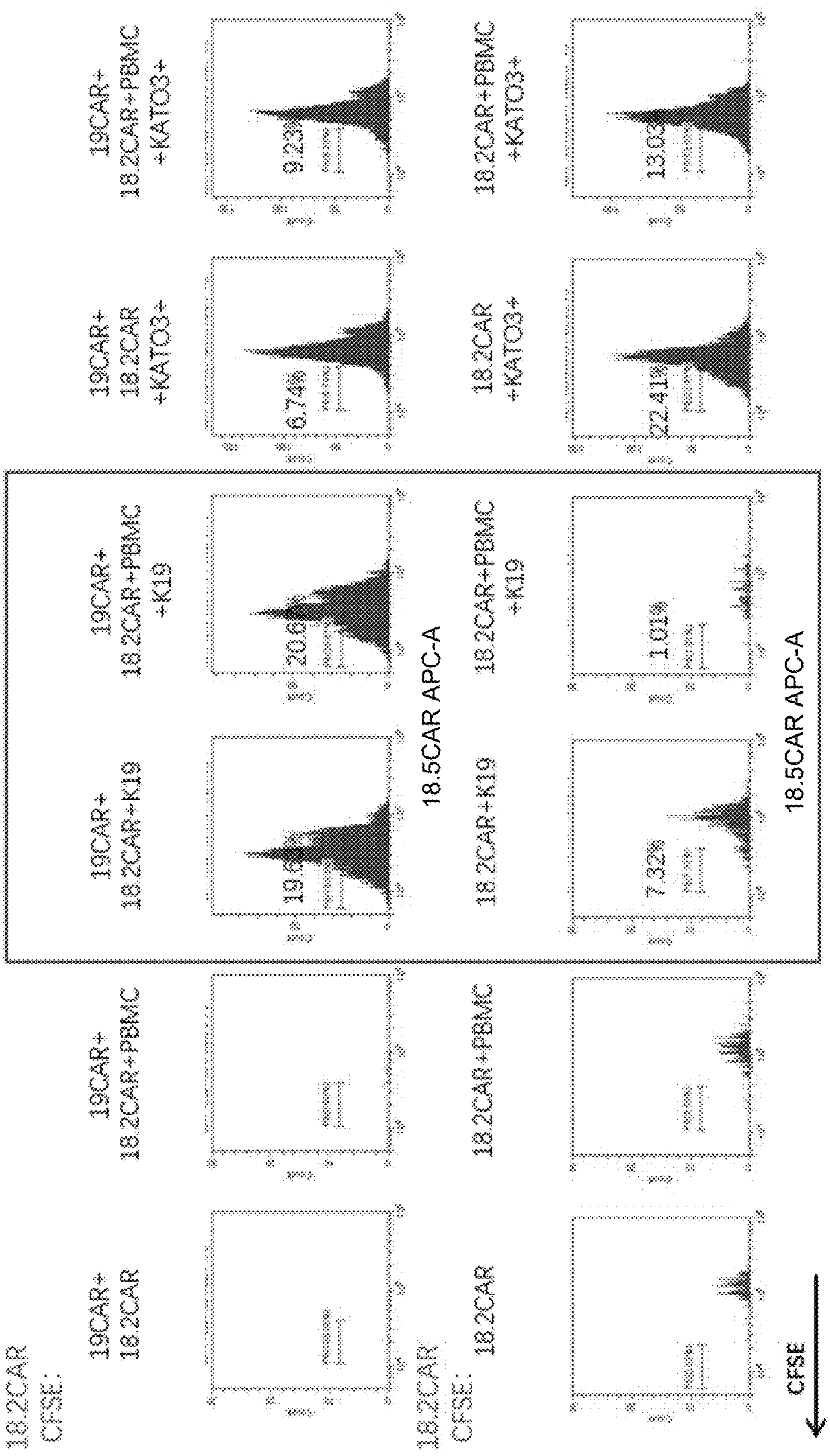
FIG. 56 shows proliferation of CLDN18.2 CAR T cells.

FIG. 56 shows the proliferation of CLDN18.2 CAR T cells. Various cells were cultured on Day 7, and flow cytometry assays were performed on Day 8. Further, CFSE reaction was measured to evaluate levels of proliferation. As shown in FIG. 56, the first row is the experimental group comprising coupled CAR co-cultured with two substrate cells, and the second row is the control group comprising CLDN18.2CAR co-cultured with two substrate cells. FIG. 56 shows that the activation of CD19 CAR T cells with K19 can induce the proliferation of CLDN18.2CAR T cells. KATO3 cells can be effectively activated by CLDN18.2 CAR T cells and then were proliferated. The presence of PBMC can further enhance proliferation. The results demonstrate that CD19 CAR is efficiently activated by K19 in the coupled CAR group and activated CD19 CART can activate CLDN18.2 CAR T cells to promote proliferation CLDN18.2 cells, which can be further enhanced by the PBMC.

Figure 57:
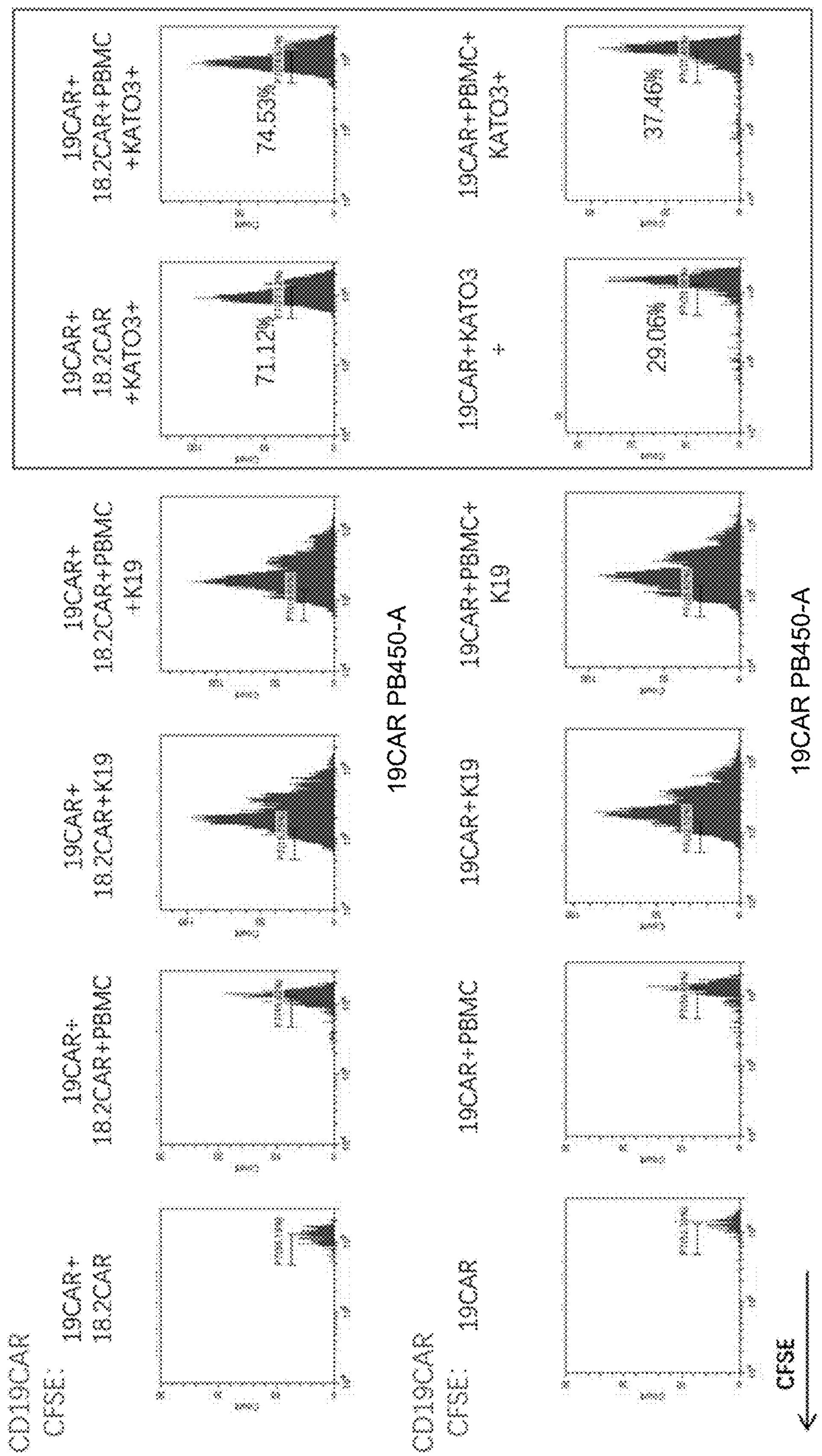
FIG. 57 shows proliferation of CD19 CAR T cells in CLDN18.2 CAR and CD19 CAR systems.

FIG. 57 shows proliferation of CD19 CAR T cells. Various cells were cultured on Day 7, and flow cytometry assays were performed on Day 8. Further, CFSE reaction was measured to evaluate the levels of proliferation. Further, CFSE reaction was measured to evaluate the levels of proliferation. As shown on FIG. 57, the first row is the experimental group comprising couple CAR T cells cocultured with two substrate cells, and the second row comprising the control group CD19 CAR T cells co-cultured with two substrate cells. FIG. 57 shows that activation of CLDN18.2 CAR T cells with KATO3+ cells can induce the proliferation of CD19 CAR T cells. The fifth and sixth columns show that PBMC can further enhance proliferation of CD19 CAR T cells. The results demonstrate that CLDN18.2 CAR T cells were activated by KATO3+ cells in the coupled CAR group and activated CLDN18.2 CAR T cells can activate CD19 CAR T cells to promote the proliferation of CD19 CAR T cells, which can be further enhanced by PBMC.

Figure 58:
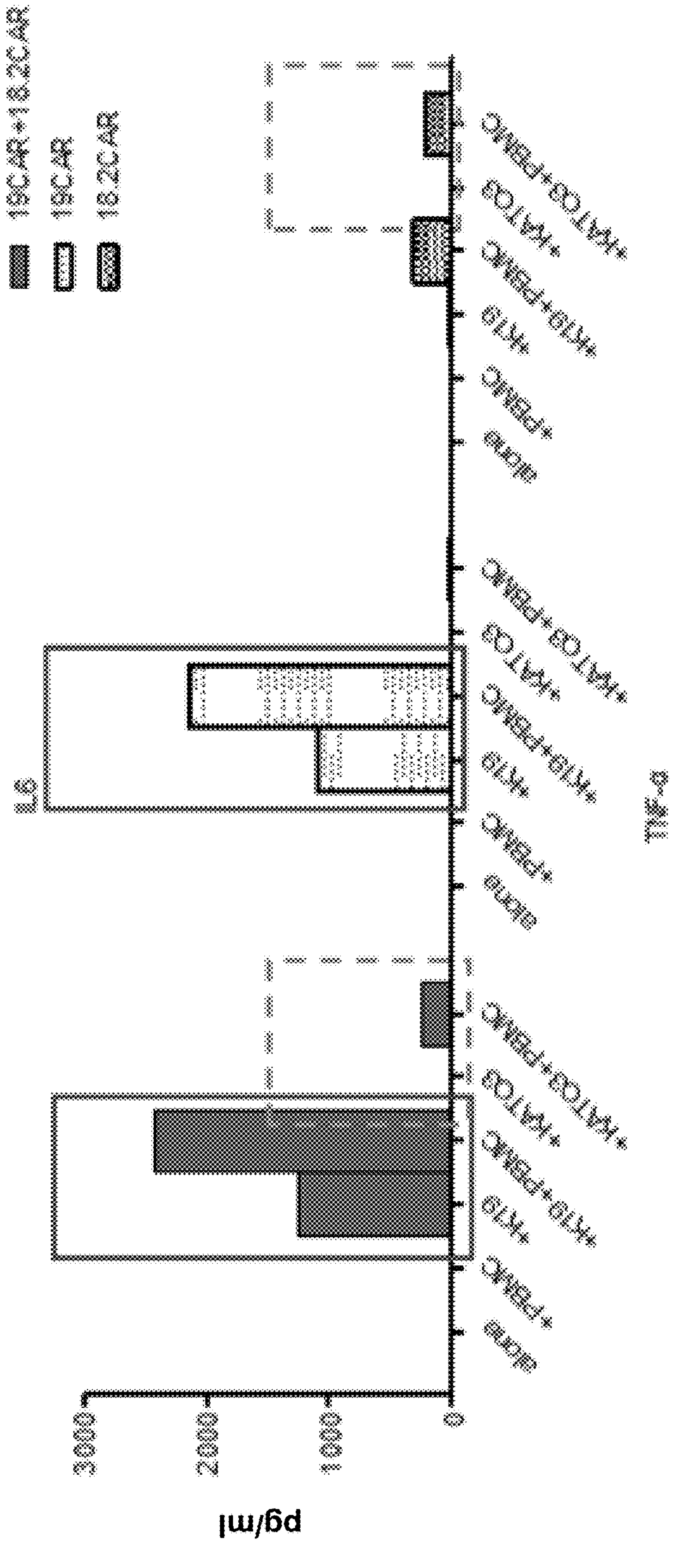
FIGS. 58, 59, and 60 show cytokine release in various cell cultures.
Figure 58:
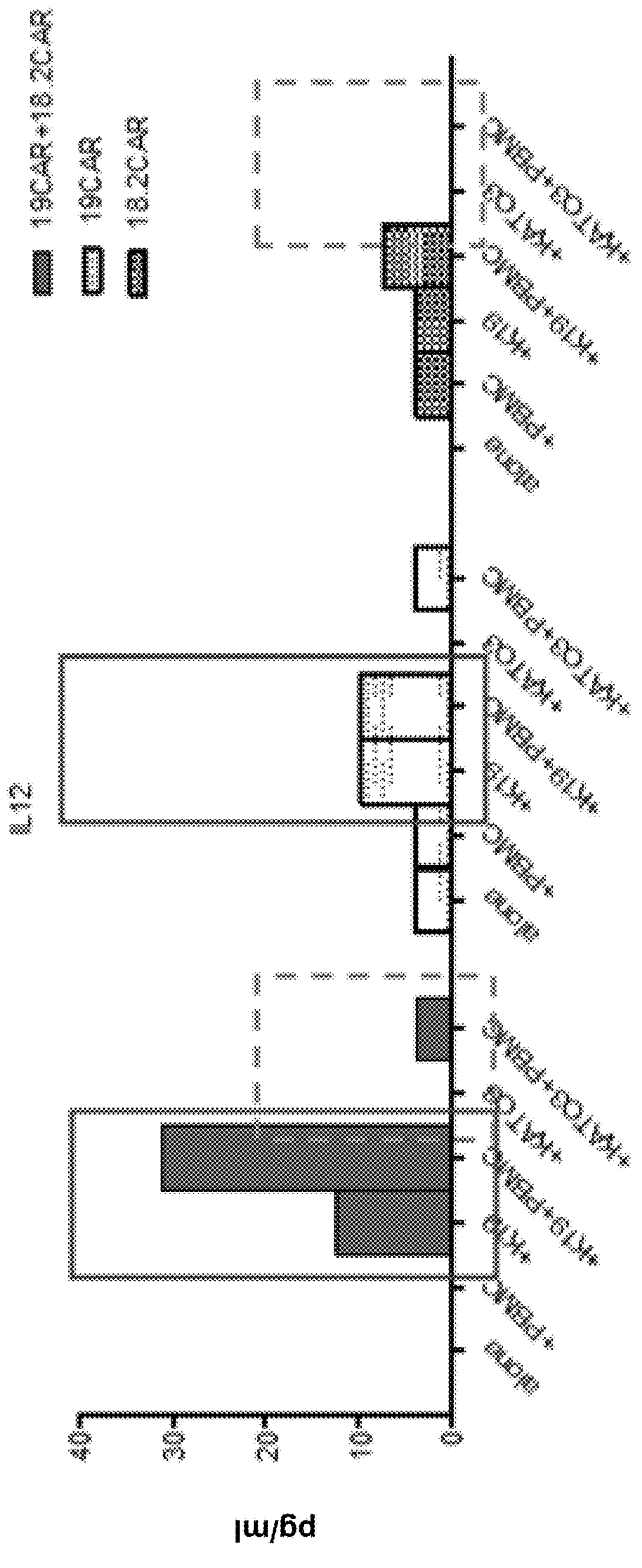
Figure 59:
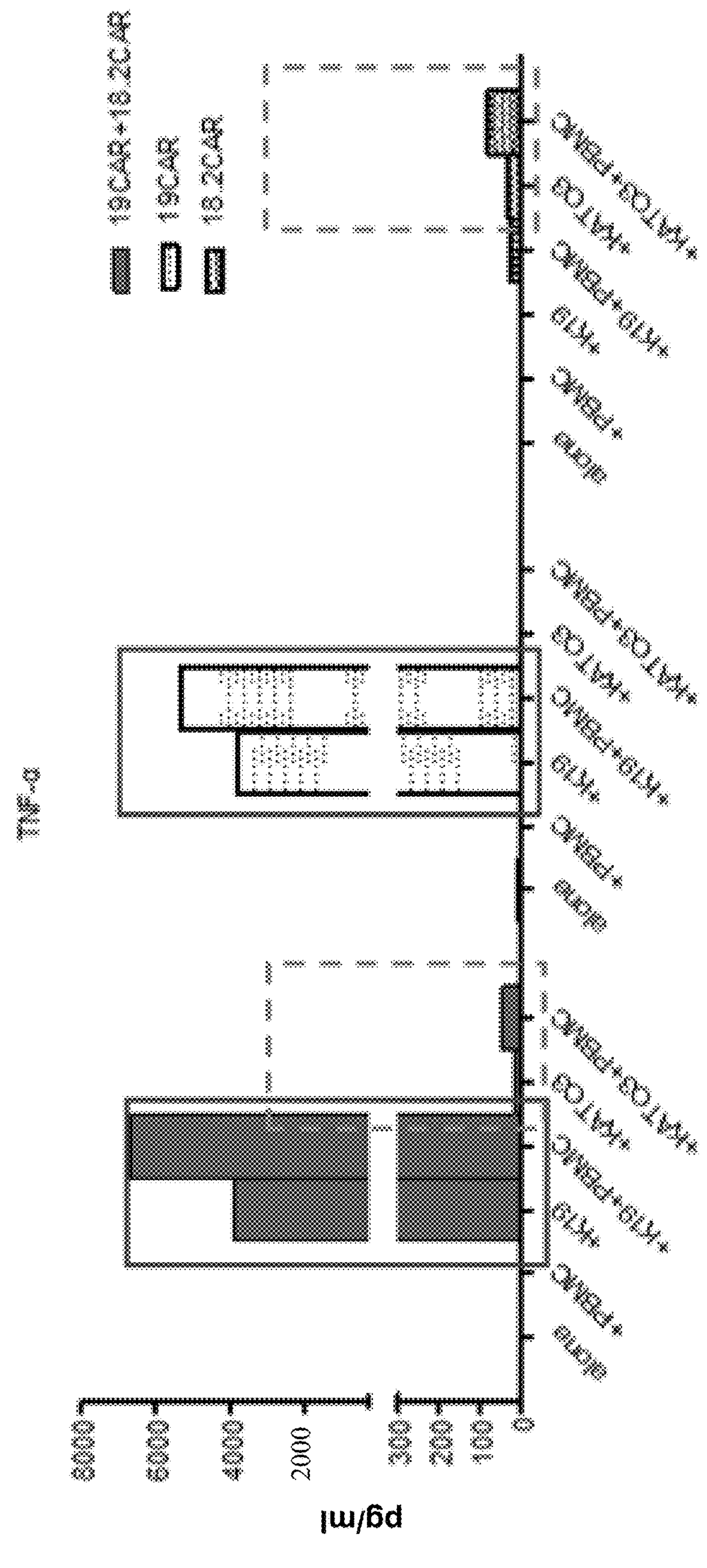
Figure 59:
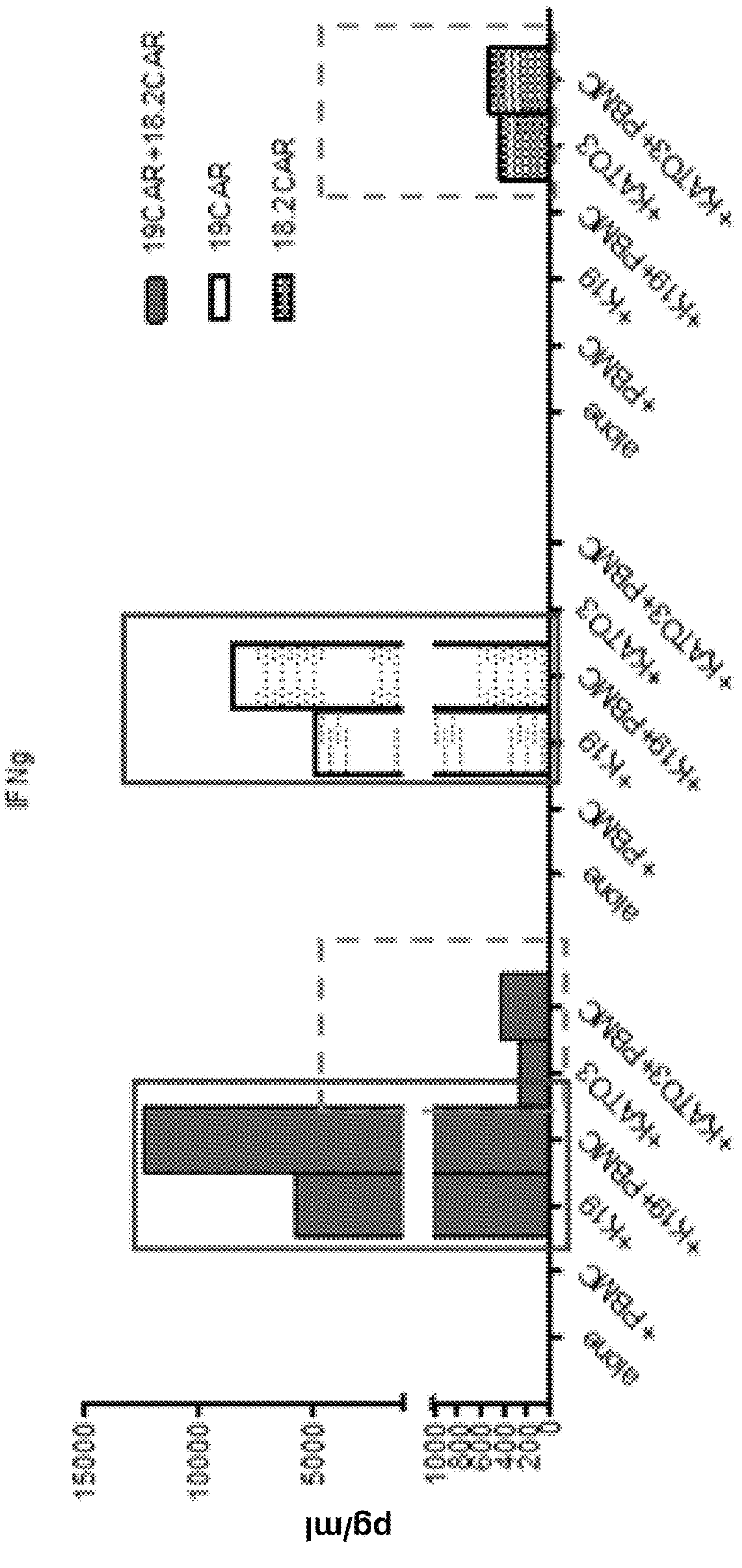
Figure 60:
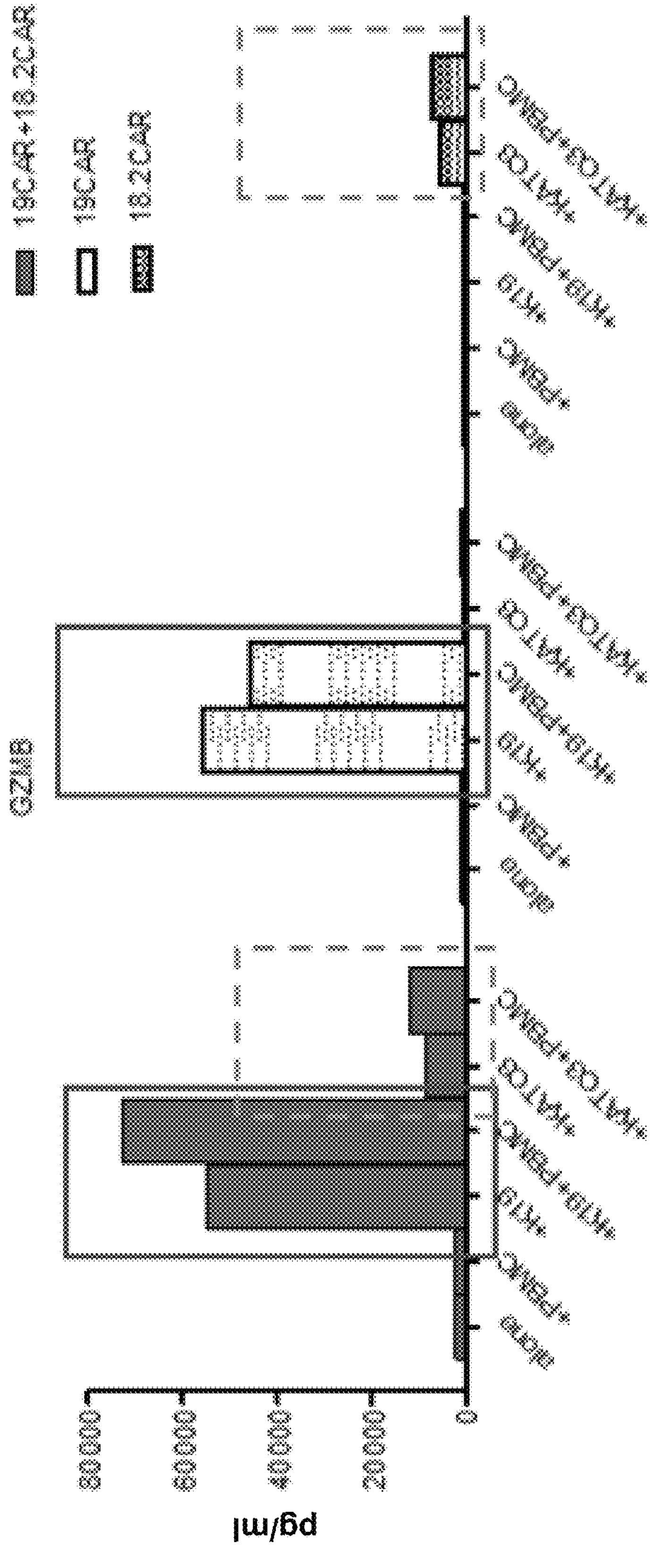

FIGS. 58-60 show cytokine release in various cell cultures. Various cells were cultured on Day 7, and flow cytometry assays were performed on Day 8. As shown, limited amounts of IL12, IFNγ and GZMB were released in the control group. The coupled CAR T cell group and single CAR T cell group were labeled with solid line and dotted line, respectively. The amount of IL12, IFNγ and GZMB released is similar in the absence of PBMC. When PBMC was added, the amount of IL12, IFNγ and GZMB released increased.

TABLE 20

| CAR T cells and substrate cells used in Group 4 | | | |
|---|---|---|---|
| | CD19 CAR T cells & ACPP CAR cells | | |
| Coupled CAR T cells CART Cell ID | CAR | Substrate Cell | Notes |
| 6404 | BCMA CAR | 8226 | BCMA positive Cell |
| 6701 | GUCY2C CAR | T84 | GUCY2C positive cell |

Figure 84:
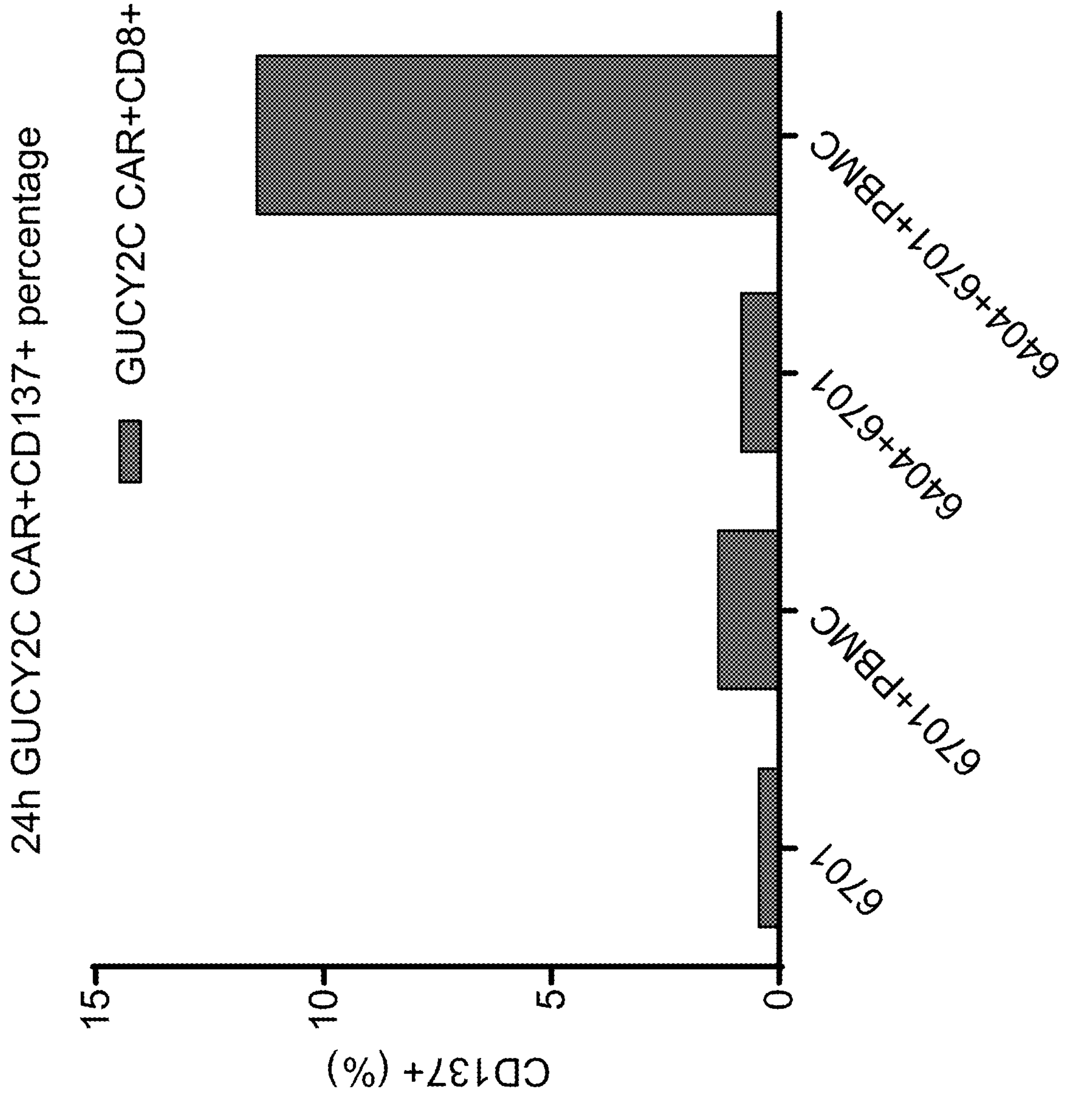
FIG. 84 shows other histograms of CD137 expression in various cell cultures.

FIG. 84 shows other histograms of CD137 expression in various cell cultures. Peripheral blood of healthy volunteers was collected on Day 0. CD3+ T cells were sorted and collected using Pan T kits, and CD3/CD28 Dynabeads were added at a 1:1 ratio to the collected CD3+ T cells. On Day 1, CD3+ T cells were transfected with lentivirus encoding BCMA CAR and GUCY2C CAR, respectively. The binding domains of CD19 CAR and ACPP CAR include SEQ ID NOs: 60 and 488, respectively. On Day 2, the lentivirus and the Dynabeads were removed, and fresh media were added. On Day 7, CAR T cells and target cells (e.g., 8226) were co-cultured for 24 hours and various assays were performed on Day 8. Flow cytometry assays were performed, and the results show expression of CD19 CAR and ACPP CAR T cells. As shown in FIG. 84, the activation of the GUCY2C CAR T cells was higher, and the activation was increased in the presence of PBMC. These results show activation of BCMA CAR T cells by 8226 can activate GUCY2C CAR T cells, and this effect is enhanced by PBMC. Since PBMC includes B cells and plasma cells that include BCMA, PBMC can activate BCMA CAR T cells. The activation of BCMA CAR T cells by PMBC is enhanced by GUCY2C CAR T cells.

Figure 85:
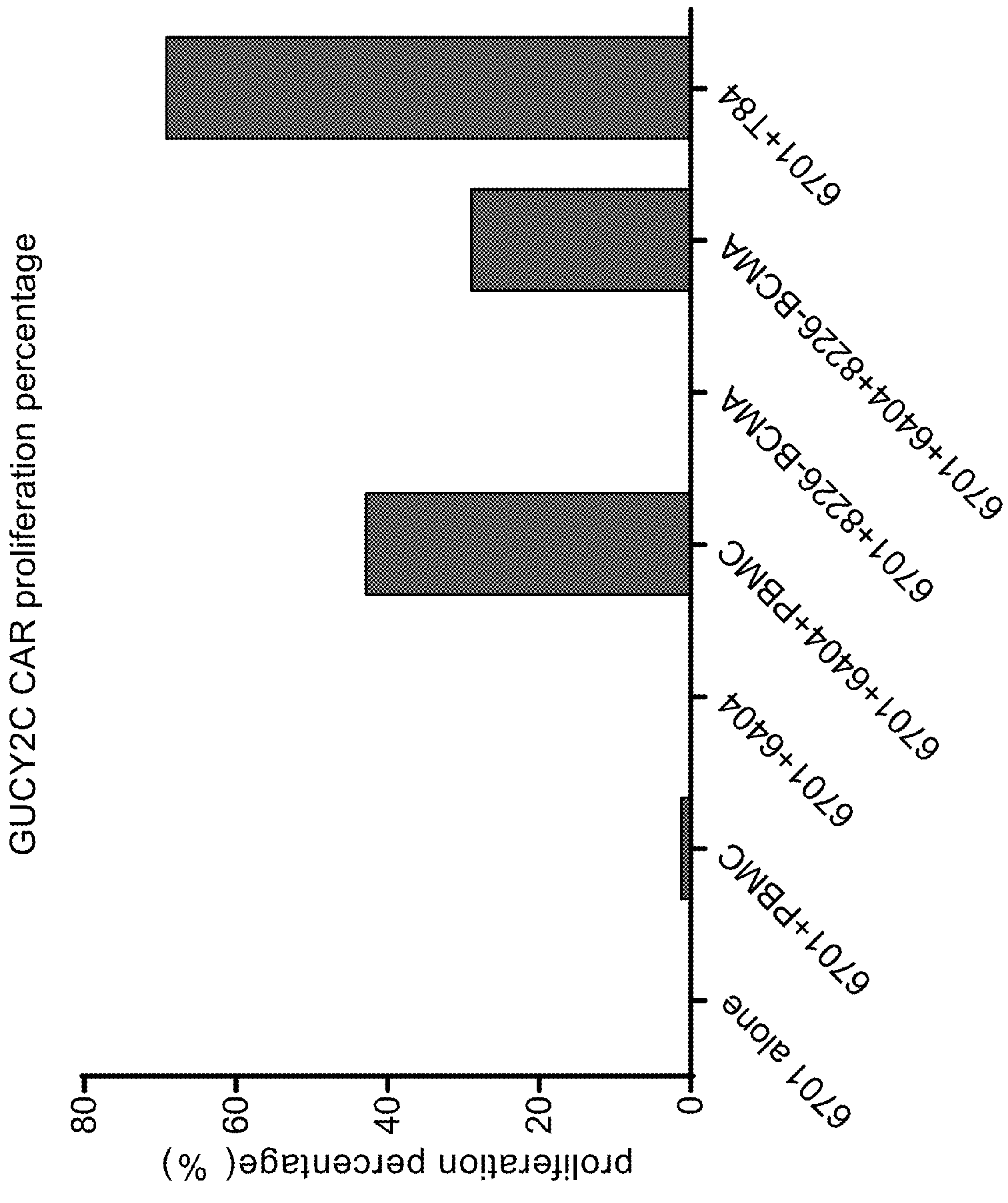
FIG. 85 shows the proliferation of GUCY2C CAR T cells.

FIG. 85 shows the proliferation of GUCY2C CAR T cells. Various cells were cultured on Day 7, and flow cytometry assays were performed on Day 8. Further, CFSE reaction was measured to evaluate levels of proliferation. PMBC includes B cells and plasma cells, which include BCMA. As shown in FIG. 85, the activation of BCMA CAR T cells with PMBC can induce the proliferation of GUCY2C CAR T cells.

Figure 86:
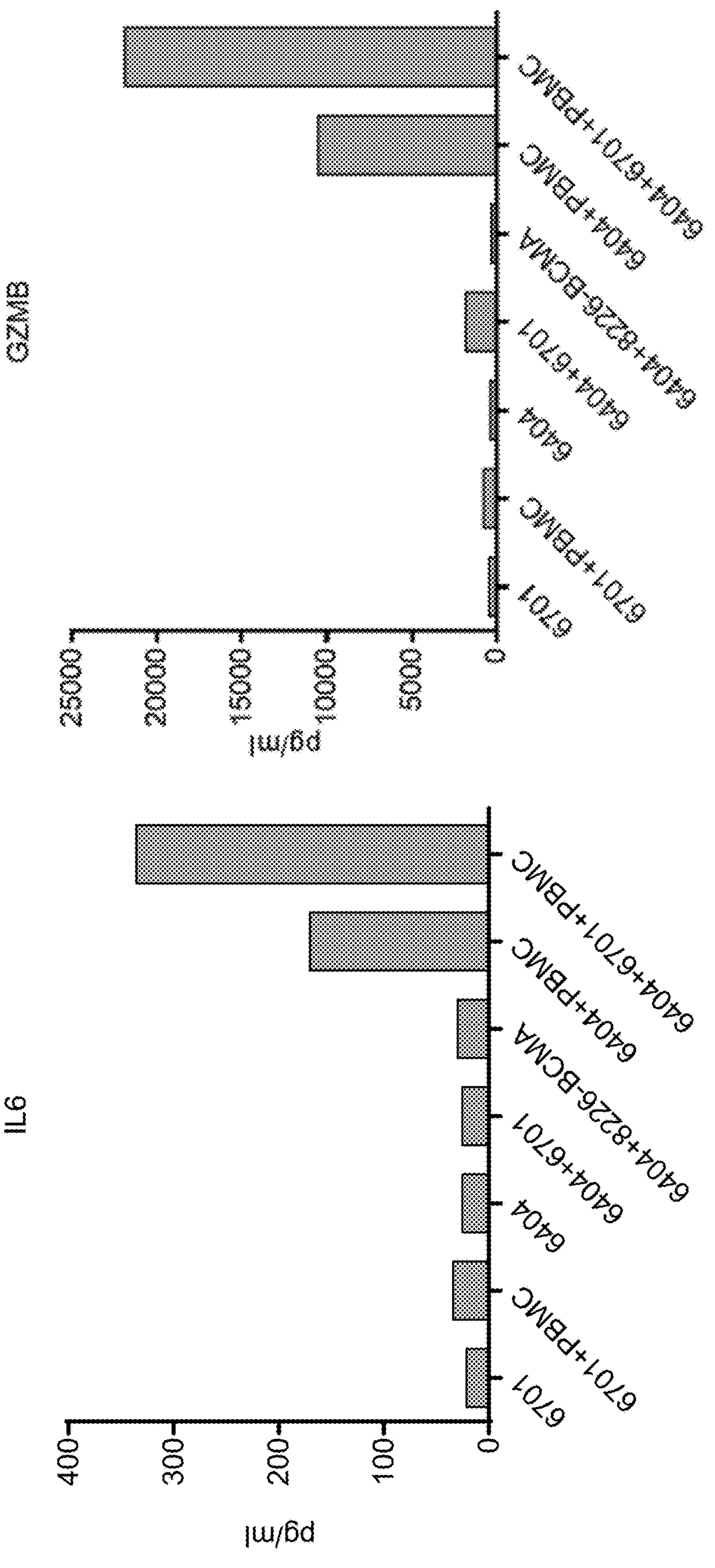
FIG. 86 shows cytokine release after cells were co-cultured for 24 hrs in cell cultures.

FIG. 86 shows cytokine release after cells were co-cultured for 24 hrs in cell cultures. There are limited amounts of IL-6, IFN-γ, GZMB released in the control group. The levels of IL-6 and GZMB released are similar in the absence of PBMC. When PBMC was added, the amount of IL-6 and GZMB released increased. The amount of released cytokines was enhanced in the coupled CAR group in the presence of PBMC.

Figure 78:
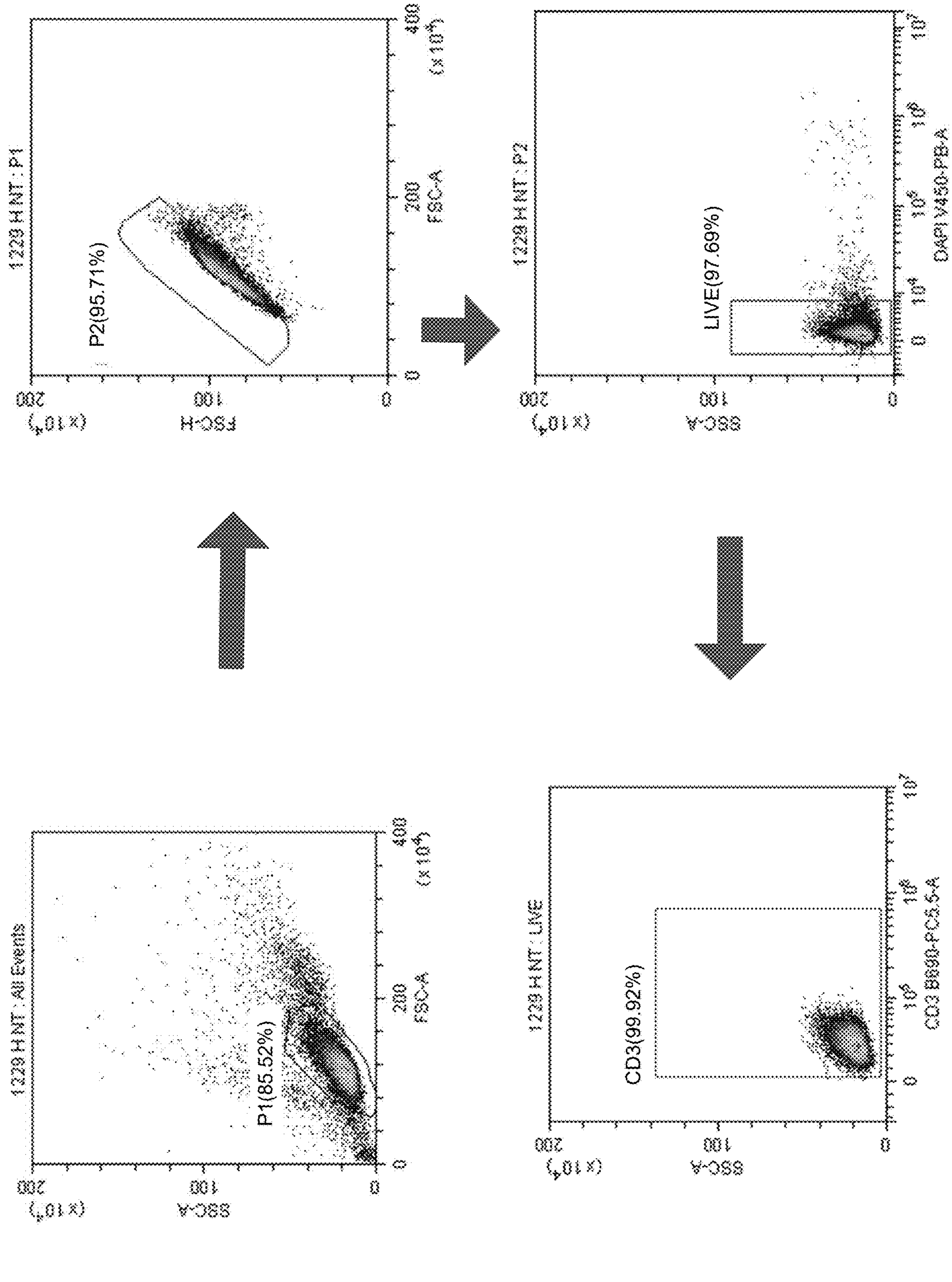
FIG. 78 illustrates the determination of phenotype and expression of a gene of interest using flow cytometry.

NY-ESO-1 transduced T cells (NYESO-1 TCRTS or 8302) and AFP transduced T cells (AFP TCRTS or DW105) were mixed with CD19 CAR T cells (1234), respectively, and co-cultured with various corresponding target cells (e.g., K19: K562-CD19). FIG. 78 illustrates the determination of phenotype and expression of a gene of interest using flow cytometry. After mixed cells were co-cultured for 7 days, flow cytometry was used to detect the phenotype of the cells and the expression of the gene of interest. For example, an approximate range of live cells was delineated (A), the adhesion cells were removed (B), DAPI staining was performed to delineate the living cell population (C), and the CD3-positive cell population (i.e., T cells) was delineated (D). Flow cytometry was used to determine the cell phenotype and CAR expression. For NT (T cells not expressing CAR) and CD19 CAR T Groups, CD8 percentages of NYESO-1 TCRTS and AFP TCRTS were 70.32%, 56.44%, 73.85% and 72.74% respectively. CD19 CAR expression was 63.71%, the expression of NYESO-1 TCR was 88.80%, and the expression of AFP TCR was 71.61%. The expression phenotypes of the cells were normal; the expression of CD137 was low; and the cells were already in a resting state, which could be used for subsequent experiments.

Figure 79:
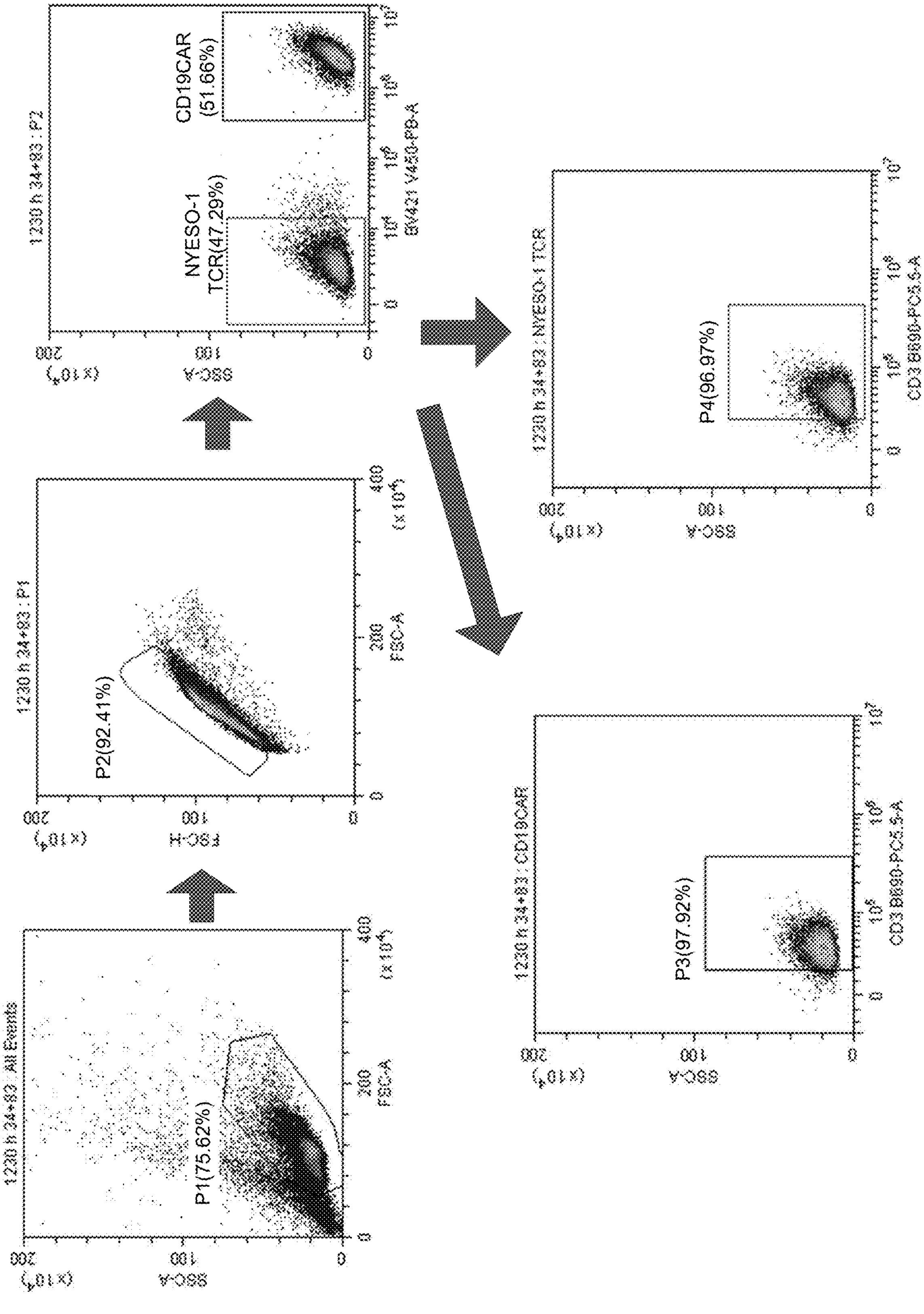
FIG. 79 shows the identification of co-cultured cells using flow cytometry.

FIG. 79 shows the identification of co-cultured cells using flow cytometry. In order to distinguish the two kinds of T cells after co-culturing, CD19 CAR cells were stained with VIOLET to be labeled with purple fluorescence. Cells were divided into two groups by flow cytometry V450-PB channel: the positive group was CD19 CAR cells, and the negative group was NYESO-1/AFP TCRTS (C). The CD3 positive population was the T cell.

Figure 80:
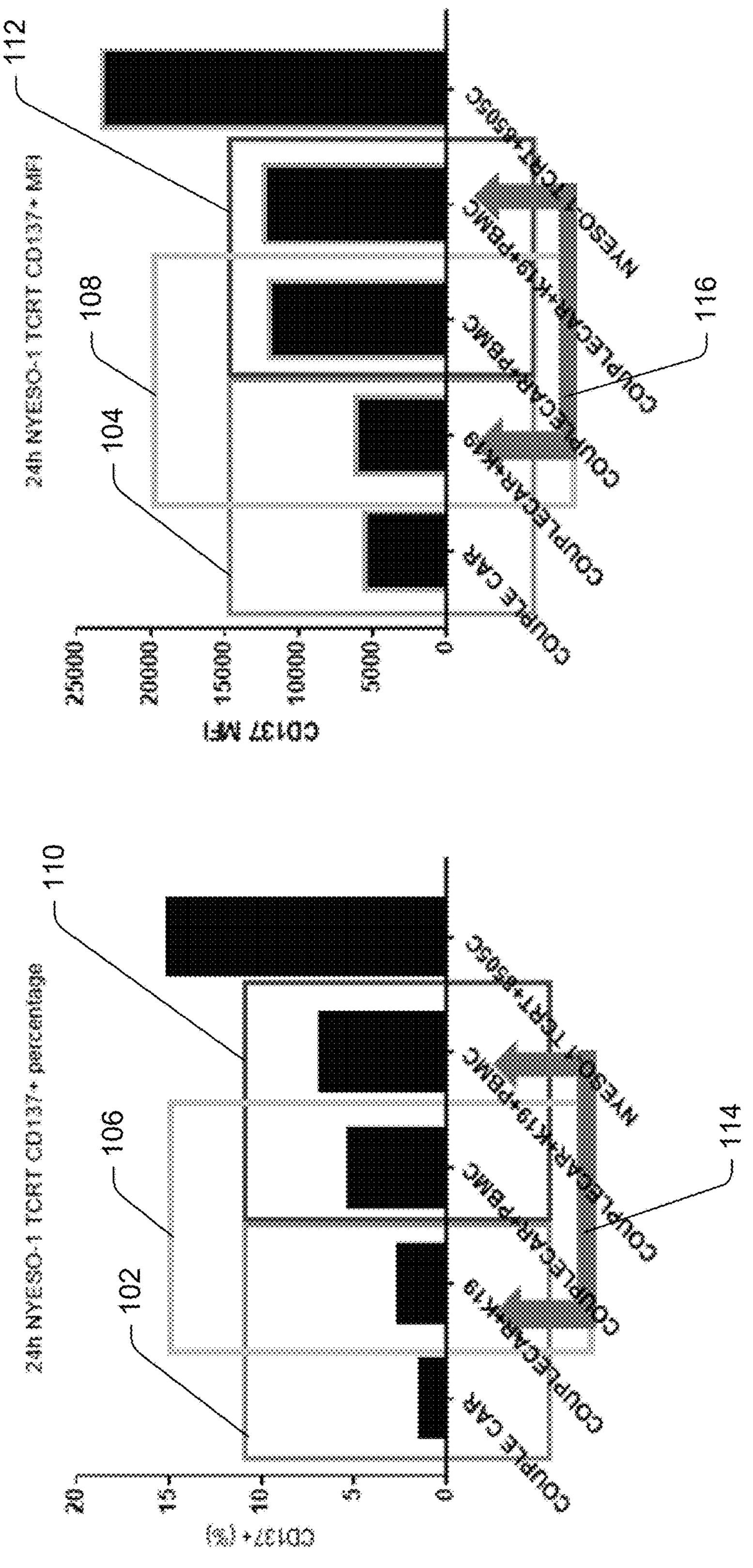
FIG. 80 shows results of flow cytometry analysis on activation of co-cultured cells including CD19 CAR T cells and NYESO-1 TCRTS. Arrows 114 and 116 as well as boxes 102, 104, 106, and 108 refer to comparison groups.

FIG. 80 shows results of flow cytometry analysis on activation of co-cultured cells including CD19 CAR T cells and NYESO-1 TCRTS. Various groups of cells were co-cultured for 24 hours, and activation of these cells was measured using flow cytometry. The activation of NYESO-1 TCRTS was very low in the control group NC (1.43% MFI=5559). The activation of NYESO-1 TCRTS in the PC group was normally (15.02%, MFI=23301). The activation of NYESO-1 TCRTS in group A (2.56%, MFI=6087) was higher than that in NC group (See 102 and 104). The activation of NYESO-1 TCRTS in group B (5.28%, MFI=12352) was higher than that of group A (2.56%, MFI=6087) (See 106 and 108). The activation of NYESO-1 TCRTS in group C (6.80%, MFI=12352) was higher than that in group B (5.28%, MFI=12352) (See 110 and 112). The activation of NYESO-1 TCRTS in group C was higher than in group A (See 114 and 116).

Figure 81:
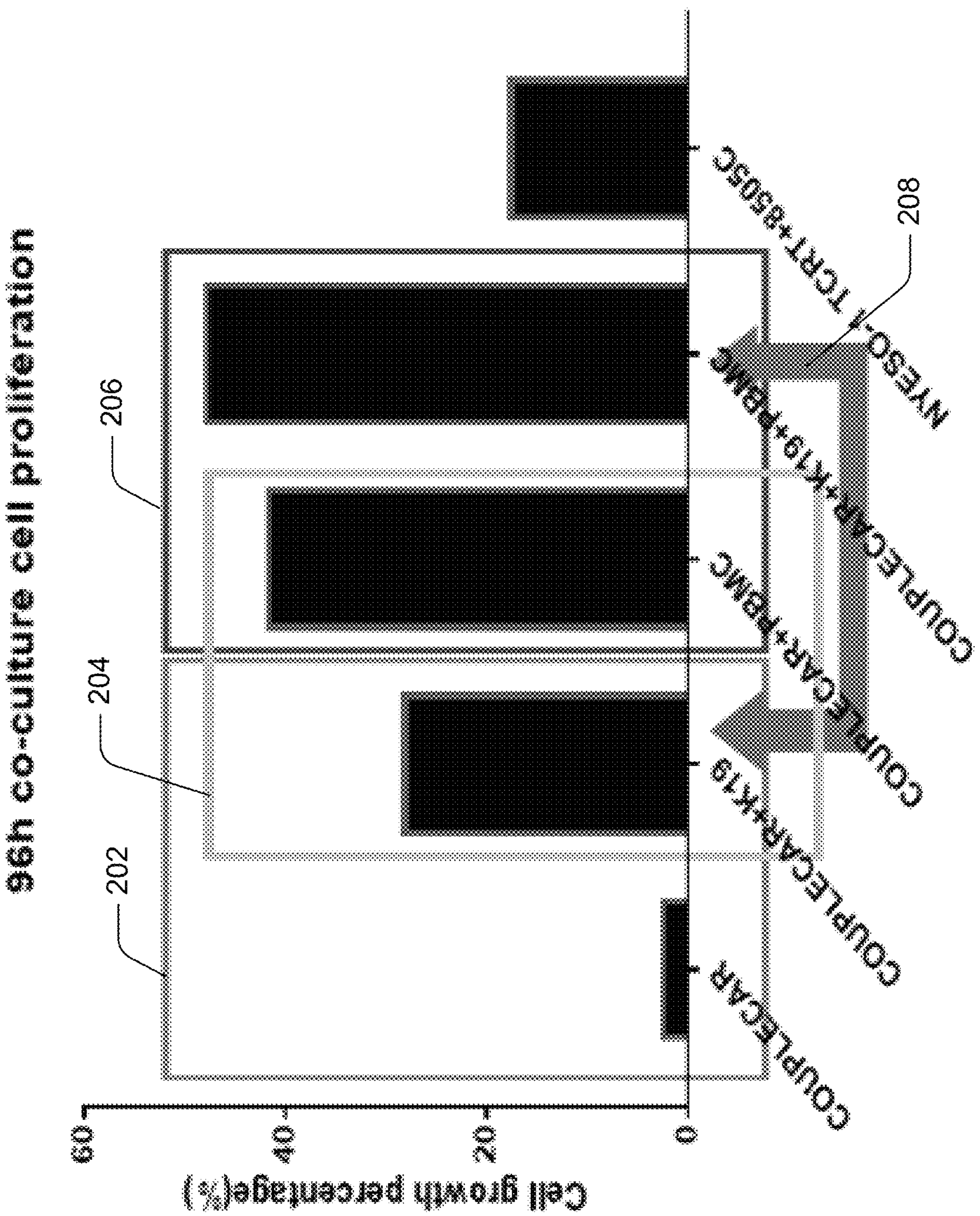
FIG. 81 show results of flow cytometry analysis on the proliferation of co-cultured cells including CD19 CAR T cells and NYESO-1 TCRTS. Arrow 208 as well as boxes 202, 204, and 206 refer to comparison groups.

FIG. 81 show results of flow cytometry analysis on the proliferation of co-cultured cells including CD19 CAR T cells and NYESO-1 TCRTS. Various groups of cells were co-cultured for 96 hours, and the proliferation of these cells was measured using flow cytometry. A comparison of cell proliferation was performed. The proliferation of NYESO-1 TCRTS cells in the NC control group was 2.46%. The proliferation of NYESO-1 TCRTS cells in group A was 28.17%, which was increased compared to the NC group (See 202). The proliferation of NYESO-1 TCRTS cells of group B was 41.60% higher than group A (See 204). The proliferation of NYESO-1 TCRTS cells of group C was 47.79%, which was higher than that of group B 41.60% (206) and higher than that of group A (See 208).

Figure 82:
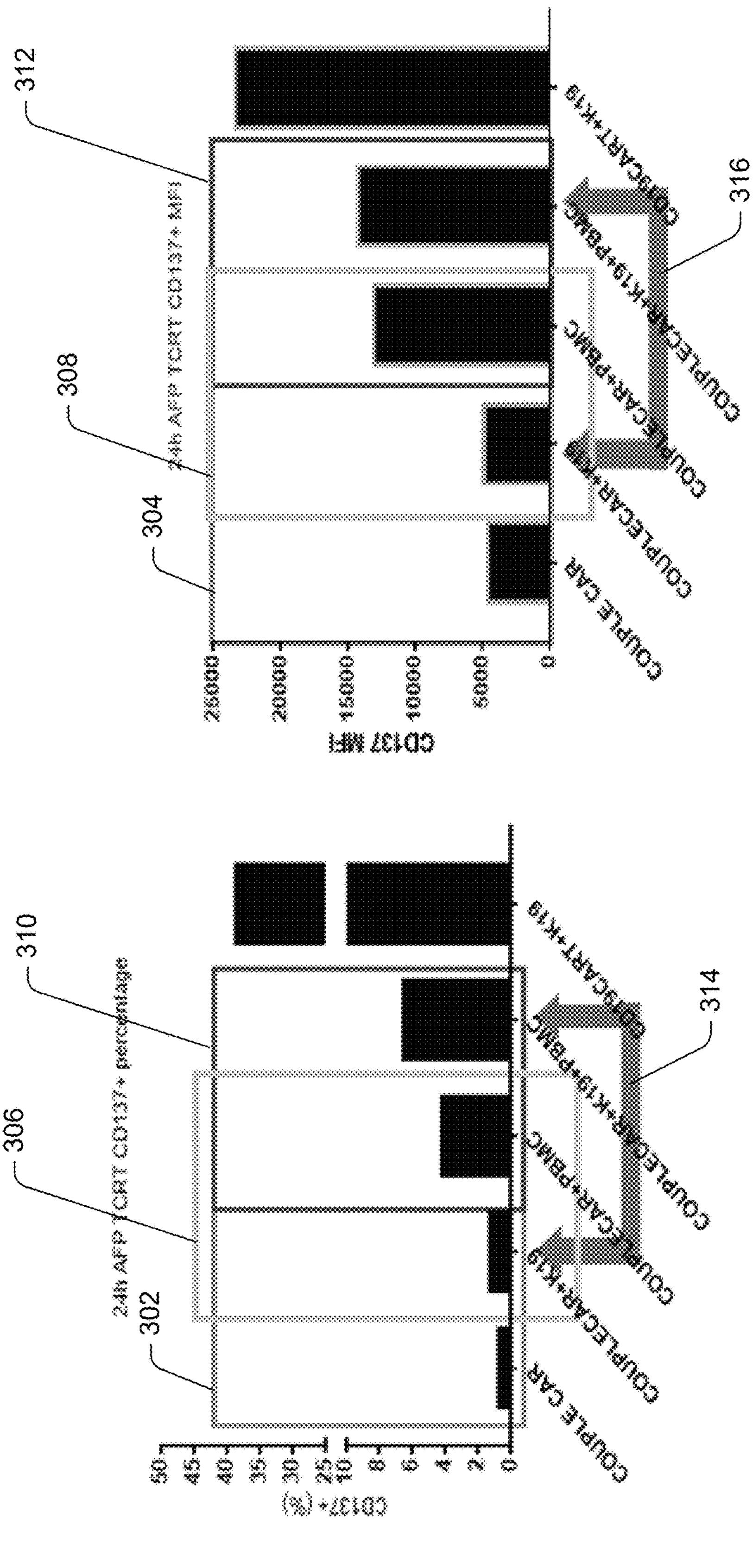
FIG. 82 show results of flow cytometry analysis on activation of co-cultured cells including CD19 CAR T cells and AFP TCRTS. Arrows 314 and 316 as well as boxes 302, 304, 306, and 308 refer to comparison groups.

FIG. 82 show results of flow cytometry analysis on activation of co-cultured cells including CD19 CAR T cells and AFP TORTS. Various groups of cells were co-cultured for 24 hours, and activation of these cells was measured using flow cytometry. The AFP TORTS of the control group NC was not activated (0.70% MFI=4568). The activation of AFP TCRTS of PC group was normally (38.58%, MFI=23327). The activation of AFP TCRTS of group A (1.24%, MFI=4884) was higher than that of NC group (See 302 and 304). The activation of AFP TCRTS of group B (4.17%, MFI=13112) was higher than that of group A (1.24%, MFI=4884) (see 306 and 308). The activation of AFP TCRTS of group C (6.47%, MFI=14218) was higher than that in group B (4.17%, MFI=13112) (see 310 and 312) and was higher than that in group A (see 314 and 316). In addition, TCR negative T cells were also partially activated (NC=0.51%; A=1.46%; B=2.84%; C=5.12%). The relationship among the groups was the same as that of the positive part.

Figure 83:
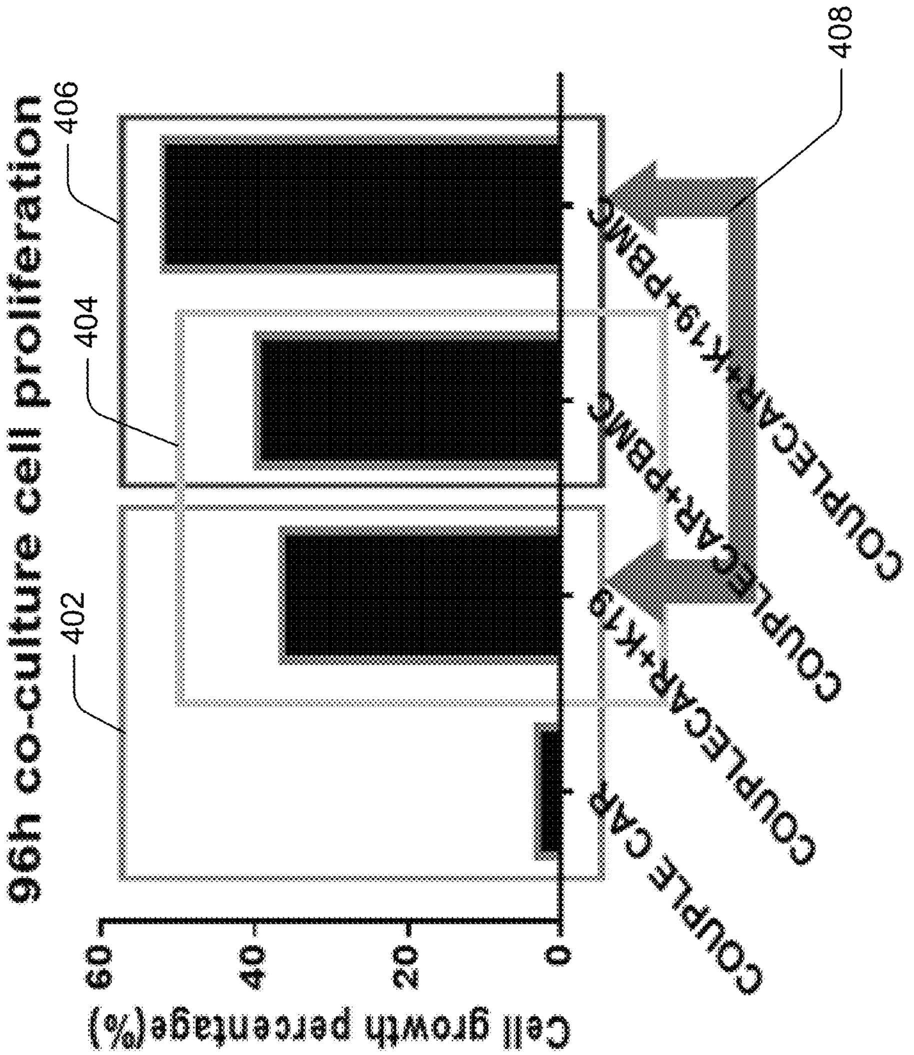
FIG. 83 show results of flow cytometry analysis on the proliferation of co-cultured cells including CD19 CAR T cells and AFP TCRTS. Arrow 408 as well as boxes 402, 404, and 406 refer to comparison groups.

FIG. 83 shows results of flow cytometry analysis on the proliferation of co-cultured cells including CD19 CAR T cells and AFP TORTS. Various groups of cells were co-cultured for 96 hours, and activation of these cells was measured using flow cytometry. A comparison of cell proliferation was performed. The proliferation rate of AFP TORTS of the NC control group was 3.11%. The proliferation rate of AFP TCRTS of group A was 36.44%, which was increased compared to NC group (402). The proliferation rate of AFP TCRTS of group B was 39.59%, which was higher than 36.44% of group A (404). The proliferation rate of AFP TCRTS of group C was 51.97%, which was higher than 39.59% (406) in group B and higher than group A (408). Thus, CD19 CAR T cells enhance TCRT cells' expansion by increasing their proliferation rates.

These data show that the activated first type of CAR T cells can activate the second type of CAR T cells in coupled CAR T cells (e.g., CD19 CAR T cells and CLDN18.2 CAR T cells). For example, the activated first type of CAR T cells enhanced the activation, cytokine releases, and cell proliferation of the second type of CAR T cells. This effect was enhanced when PBMC was present. Given that PBMC and monocytes were activated, the first type of CAR T cells can activate monocytes (e.g., DCs), which can then activate the second type of CAR T cells. The combination of the data presented here and the data shown in the in vivo Examples of the present disclosure shows that subjects' dendritic cells (DCs) work as a medium to associate the activation of the first type of CAR T cells with the activation of the second type of CAR T cells and form a positive circle of activations, which may contribute to the expansion of CAR T cells observed in the subjects (Patients 004-011) due to amplification of immune homeostasis. These data and the clinical data above indicate that coupled or mixed T cells achieve enhanced T cell response including the expansion of T cells and/or cytokine release. Examples of the coupled or mixed T cells include BCMA and GUCY2C CAR T cells as well as CD19 CAR T cells and NYESO-1 TCRTS. After infusion of the mixed T cells to patients, a first group of T cells (e.g., CD19 and BCMA CAR T cells) bind an antigen of B cells and are activated. After their activation, the first group of CAR T cells up-regulates certain membrane molecules (e.g., CD28, OX40, 4-1BB, CD40L, etc.) and release certain cytokines (e.g., IFNγ and GM-CSF). These surface molecules and cytokines activate and/or recruit cells such as monocytes (e.g. DCs) and neutrophils. The recruited and/or activated cells release cytokines (e.g., TNFα, IL6, IL12) to form an inflammatory-like environment. In light of the inflammatory-like environment, these activated immune cells up-regulate some proteins (e.g., CD80, CD80, and CD40), which activate a second group of T cells (e.g., NT, CAR T cells targeting solid tumors, and NYESO-1 TCRTS). Also, cytokines (e.g., IFNγ) secreted by the first group of T cells also activate the second group of T cells.

Example 4. Modified Cells Using ZFNs. TALENs, and/or Cas9

Multiple gene-specific ZFNs were constructed to enable the site-specific introduction of mutations. Various ZFNs were designed and incorporated into plasmid vectors essentially as described in Mala et al. (2005) Biochem Biophys Res Commun 335 (2): 447-57, Liu et al. (2002) J Bio Chem 277 (6): 3850-6, Sander et al. (2011) Nat Methods. 8 (1): 67-9, Urnov et al. (2005) Nature 435 (7042): 646-651, and U.S. Patent Publication 2008/0131962. The ZFNs included various combinations of Zinc finger binding domains (e.g., ZFN-left and ZFN-right binding domains), which are listed in Table 14 and Table 15. The cleavage domain of the ZFNs comprised an engineered Fokl cleavage domain (SEQ ID NOs: 280, 281, or 282).

TABLE 14

Exemplary ZFN pairs as well as the target sequences (Target site: the target sequence for ZFN include two 9-bp recognition sites (i.e., upper case letters) are separated by a 6-bp spacer)

| Gene Name | ICT ZFN Number | ZFN | Finger 1 | SEQ ID NO: | Finger 2 | SEQ ID NO: | Finger 3 | SEQ ID NO: | Target site | SEQ ID NO: |
|---|---|---|---|---|---|---|---|---|---|---|
| CTLA4 | ICTZF1L | ZFN-L | QSGSLTR | 301 | DRSDLTR | 302 | QSSALTR | 303 | TGCGGCAA | 304 |
| | ICTZF1R | ZFN-R | QRSNLVR | 306 | RSDHLTR | 306 | TSANLSR | 307 | CctacatGATG GGGAA | |
| LAG3 | ICTZF2L | ZFN-L | QSSDLTR | 308 | RSDNLAR | 309 | QSGHLQR | 310 | AGCCTCTCC | 311 |
| | ICTZF2R | ZFN-R | RSDNLAR | 309 | QSSDLTR | 308 | RSDHLSR | 312 | agccaGGGG CTGAG | |
| LAG3 | ICTZF3L | ZFN-L | RSDHLAR | 313 | QSGDLTR | 314 | RSDDLTR | 315 | CCCTGCCG | 319 |
| | ICTZF3R | ZFN-R | RSDALTR | 316 | TSGHLVR | 317 | QSSDLQR | 318 | CctgcctGCTG GTGTG | |

TABLE 14-continued

Exemplary ZFN pairs as well as the target sequences (Target site: the target sequence for ZFN include two 9-bp recognition sites (i.e., upper case letters) are separated by a 6-bp spacer)

| Gene Name | ICT ZFN Number | ZFN | Finger 1 | SEQ ID NO: | Finger 2 | SEQ ID NO: | Finger 3 | SEQ ID NO: | Target site | SEQ ID NO: |
|---|---|---|---|---|---|---|---|---|---|---|
| BTLA | ICTZF4L | ZFN-L | GGTALRM | 320 | QRSSLVR | 321 | QRNNLGR | 322 | GTTTACTTC | 326 |
| | ICTZF4R | ZFN-R | RKRNLIM | 323 | VRHNLTR | 324 | RGDKLGP | 326 | ctttggGGGGA TTGC | |
| TIM3 | ICTZF5L | ZFN-L | SRFTLGR | 327 | RREHLVR | 328 | QTATLKR | 329 | CACCCCTG | 333 |
| | ICTZF5R | ZFN-R | KHSNLAR | 330 | QSTTLKR | 331 | RADGLQL | 332 | CaccgacTCG GCAGAG | |
| TIM3 | ICTZF6L | ZFN-L | TRQKLET | 334 | RQDNLGR | 335 | QQHGLRH | 336 | ACCCTCACA | 340 |
| | ICTZF6R | ZFN-R | TKKILTV | 337 | HKSSLTR | 338 | RSDHLSL | 339 | accttTGGGTT GTC | |
| FOXP3 | ICTZF7L | ZFN-L | RKHHLGR | 341 | RREHLVR | 28 | VSNSLAR | 342 | CCCCCCAG | 346 |
| | ICTZF7R | ZFN-R | RTSSLKR | 343 | QRSDLTR | 344 | RSDGLRG | 345 | CacccttTCGG CTGTG | |
| FOXP3 | ICTZF8L | ZFN-L | DSPTLRR | 347 | QSAHLKR | 348 | QDVSLVR | 349 | GGCTCCTG | 352 |
| | ICTZF8R | ZFN-R | MKNTLTR | 350 | QRSDLTR | 344 | QSGTLTR | 351 | CtgcatcGTAG CTGCT | |
| SIVA1 | ICTZF9L | ZFN-L | TKQILGR | 353 | QSTTLKR | 331 | RTEHLAR | 354 | AGCTGCCC | 296 |
| | ICTZF9R | ZFN-R | KRRDLDR | 355 | RREVLEN | 300 | DPSNLRR | 299 | CttcgcgGACG TGGCC | |
| LGALS9 | ICTZF10L | ZFN-L | MKHHLDA | 298 | VRHNLTR | 324 | HHNSLTR | 297 | ACCATCAAC | 293 |
| | ICTZF10R | ZFN-R | KKDHLHR | 295 | RREVLEN | 300 | QTVNLDR | 294 | agactgGAAG TGGGG | |
| CD33 | ICTZF11L | ZFN-L | QSGSLTR | 301 | RSDDLQR | 292 | RSDHLSR | 312 | TGCCGCCC | 289 |
| | ICTZF11R | ZFN-R | QSGHLAR | 291 | TSGNLVR | 290 | QSGHLQR | 310 | CtactgtGGAG ATGGA | |
| SIVA1 | ICTZF12L | ZFN-L | QSSDLTR | 308 | QSGDLTR | 314 | RSDHLSR | 312 | AGCTGCCC | 285 |
| | ICTZF12R | ZFN-R | ERGTLAR | 288 | RSDALSR | 287 | DRSNLTR | 286 | CttcgcgGACG TGGCC | |
| FOXP3 | ICTZF13L | ZFN-L | ERGTLAR | 288 | QSGHLQR | 310 | QSGDLTR | 314 | GGCTCCTG | 283 |
| | ICTZF13R | ZFN-R | QSSDLTR | 308 | QSSDLTR | 308 | QRASLTR | 284 | CtgcatcGTAG CTGCT | |

ZFN-left arm plasmid vectors and ZFN-right arm plasmid vectors were transfected into Hela cells using fugene transfection reagent, respectively. 24 hours after transfection, Hela cells were treated with 1 μg/ml puromycin for 48 hours to obtain cells rich in ZFNs. Hela cells were then collected. Lysed DNA fragments containing ZFNs were amplified by PCR using primers specific to various genes (i.e., CTLA4, LAG3, BTLA, TIM3, FOXP3, SIVA1, or LGALS9) and the genome of Hela cells as templates. The DNA fragments were sequenced using forward primers. The DNA fragments were cloned into vectors. The DNA fragments of about 30 monoclonal cells were sequenced to determine whether the DNA fragments include mutations. The results of the sequencing are shown in Table 15.

TABLE 15

Monoclonal sequencing results for ZFNs that target gene fragments, which are amplified by PCR.

| ZFN Left | ZFN Right | Number of clones analyzed | Number of clones mutated | Mutation frequency |
|---|---|---|---|---|
| ICTZF1L | ICTZF1R | 31 | 6 | 19% |
| ICTZF2L | ICTZF2R | 26 | 3 | 12% |

TABLE 15-continued

Monoclonal sequencing results for ZFNs that target gene fragments, which are amplified by PCR.

| ZFN Left | ZFN Right | Number of clones analyzed | Number of clones mutated | Mutation frequency |
|---|---|---|---|---|
| ICTZF3L | ICTZF3R | 30 | 9 | 30% |
| ICTZF4L | ICTZF4R | 30 | 4 | 13% |
| ICTZF5L | ICTZF5R | 29 | 1 | 3% |
| ICTZF6L | ICTZF6R | 30 | 4 | 13% |
| ICTZF7L | ICTZF7R | 29 | 5 | 17% |
| ICTZF8L | ICTZF8R | 33 | 7 | 21% |
| ICTZF9L | ICTZF9R | 34 | 10 | 29% |
| ICTZF10L | ICTZF10R | 27 | 2 | 7% |
| ICTZF11L | ICTZF11R | 34 | 14 | 41% |
| ICTZF12L | ICTZF12R | 24 | 3 | 13% |
| ICTZF13L | ICTZF13R | 21 | 5 | 24% |

Multiple gene-specific ZFNs were constructed to enable site-specific introduction of mutations. Various ZFNs were designed and incorporated into plasmid vectors essentially as described (Mala et al. (2005) Biochem Biophys Res Commun 335 (2): 447-57; Liu et al. (2002) J Bio Chem 277

(6): 3850-6; Sander et al. (2011) Nat Methods. 8 (1): 67-9; Handel et al. (2009) Mol Ther. January; 17 (1): 104-11; Urnov et al. (2005) Nature 435 (7042): 646-651; and U.S. Patent Publication 2008/0131962; which are incorporated by reference in their entireties). The ZFNs included various combinations of Zinc finger binding domains (e.g., ZFN-left and ZFN-right binding domains), which are listed in Table 16. The cleavage domain of the ZFNs comprises an engineered FokI cleavage domain (SEQ ID NOS.: 96, 97, or 98).

TABLE 16

Exemplary ZFN pairs as well as the target sequences (Target site: the target sequence for ZFN include two 9-bp recognition sites (i.e., uppercase letters) separated by a 6-bp spacer).

| Gene Name | ICT ZFN # | ZFN | Finger 1 | Finger 2 | Finger 3 | Target site | Linker between ZFP and FokI |
|---|---|---|---|---|---|---|---|
| B2M | ICTZF 14L | ZFN-L | RTSSLKR (SEQ ID NO: 357) | QRSDLTR (SEQ ID NO: 358) | RSDHLSL (SEQ ID NO: 359) | CACAGCCC AagatagtTAA GTGGGG (SEQ ID NO: | TGPGAAARA (SEQ ID NO: 417) |
| | ICTZF 14R | ZFN-R | KKDHLHR (SEQ ID NO: 361) | RREVLEN (SEQ ID NO: 362) | QRGNLNM (SEQ ID NO: 363) | 360) | TGPGAAARA (SEQ ID NO: 417) |
| CIITA | ICTZF 15L | RZFN-L | VPSKLKR (SEQ ID NO: 364) | EAHHLSR (SEQ ID NO: 265) | QDGNLTR (SEQ ID NO: 366) | GCCACCTT CccccaGCTG AAGTC | LRGSQ (SEQ ID NO: 418) |
| | ICTZF 15R | ZFN-R | TSTLLN (SEQ ID NO: 367) | QQTNLTR (SEQ ID NO: 368) | VGNSLTR (SEQ ID NO: 369) | (SEQ ID NO: 400) | LRGSQ (SEQ ID NO: 418) |
| | ICTZF 16L | ZFN-L | QSGSLTR (SEQ ID NO: 370) | TSGNLVR (SEQ ID NO: 371) | QSGDLTR (SEQ ID NO: 372) | TGCATCTG CgacgtgGGA GCCGAG | LRGSQ (SEQ ID NO: 418) |
| | ICTZF 16R | ZFN-R | RSDNLAR (SEQ ID NO: 373) | DRSDLTR (SEQ ID NO: 374) | QSGHLQR (SEQ ID NO: 375) | (SEQ ID NO: 401) | LRGSQ (SEQ ID NO: 418) |
| | ICTZF 17L | ZFN-L | DRSHLTR (SEQ ID NO: 376) | RSDALSR (SEQ ID NO: 377) | QSSDLQR (SEQ ID NO: 378) | GCCCACAG CcactcGTGG CGGCC | LRGSQ (SEQ ID NO: 418) |
| | ICTZF 17R | ZFN-R | ERGTLAR (SEQ ID NO: 379) | RSDDLQR (SEQ ID NO: 380) | RSDALTR (SEQ ID NO: 381) | (SEQ ID NO: 402) | LRGSQ (SEQ ID NO: 418) |
| | ICTZF 18L | ZFN-L | RSDHLAR (SEQ ID NO: 382) | QSGDLTR (SEQ ID NO: 383) | QSGHLQR (SEQ ID NO: 384) | CCCTGCTC CctccgGGGG CTGCT | LRGSQ (SEQ ID NO: 418) |
| | ICTZF 18R | ZFN-R | QSSDLTR (SEQ ID NO: 385) | QSSDLTR (SEQ ID NO: 385) | RSDHLSR (SEQ ID NO: 387) | (SEQ ID NO: 403) | LRGSQ (SEQ ID NO: 418) |
| | ICTZF 19L | ZFN-L | QSGHLAR (SEQ ID NO: 388) | DRSDLTR (SEQ ID NO: 389) | QSGNLAR (SEQ ID NO: 390) | TCCGGCTT CtccatGGAG CAGGC | LRGSQ (SEQ ID NO: 407) |
| | ICTZF 19R | ZFN-R | DRSHLTR (SEQ ID NO: 391) | QSGDLTR (SEQ ID NO: 392) | QSGHLQR (SEQ ID NO: 393) | (SEQ ID NO: 404) | LRGSQ (SEQ ID NO: 418) |
| | ICTZF 20L | ZFN-L | RSHILTN (SEQ ID NO: 394) | QSTTLKR (SEQ ID NO: 395) | DGGHLTR (SEQ ID NO: 396) | CACTGCGC CcacgagGCC GAGGAG | LRGSQ (SEQ ID NO: 418) |
| | ICTZF 20R | ZFN-R | RQMNLDR (SEQ ID NO: 397) | RQDNLGR (SEQ ID NO: 398) | DKSVLAR (SEQ ID NO: 399) | (SEQ ID NO: 405) | LRGSQ (SEQ ID NO: 418) |

ZFN-left arm plasmid vectors and ZFN-right arm plasmid vectors were transfected into Hela cells using fugene transfection reagent, respectively. 24 hours after transfection, Hela cells were treated with 1 μg/ml puromycin for 48 hours to obtain cells rich in ZFNs. Hela cells were then collected. Lysed DNA fragments containing ZFNs were amplified by PCR using primers specific to the various genes (i.e., B2M and CIITA) and the genome of Hela cells as templates. The DNA fragments were sequenced using forward primers. The DNA fragments were cloned into vectors. The DNA fragments of about 30 monoclonal cells were sequenced to determine whether the DNA fragments include mutations. The results of the sequencing are shown in Table 18. T cells were introduced with TRAC-specific ZFNs constructed to enable the site-specific introduction of mutations at TRAC gene. Various ZFNs were designed and incorporated into plasmids vectors essentially as described (Urnov et al. (2005) Nature 435 (7042): 646-651; Lombardo et al. (2007) Nat Biotechnol. November 25 (11): 1298-306; and U.S. Patent Publication 2008/0131962; which are incorporated by reference in their entireties). The ZFNs included various combinations of Zinc finger binding domains (e.g., ZFN-left and ZFN-right binding domains), which are listed in Table 17. The cleavage domain of the ZFNs comprises a FokI cleavage domain (SEQ ID NOs: 96, 97, or 98). mRNA encoding a pair of ZFNs (see Table 17) was introduced into the transduced cells to modify a target genomic locus associated with the a chain of TCR.

TABLE 17

| ZFN | Recognition Sequence | F1 | F2 | F3 | F4 | F5 | F6 |
|---|---|---|---|---|---|---|---|
| ZFLm1 (left) | GTTGCTCCAGG CCACAGCA (SEQ ID: 408) | QSGDLTR (SEQ ID: 409) | QWGTRY (SEQ ID: 410) | ERGTLAR (SEQ ID: 411) | RSDNLRE (SEQ ID: 386) | QSGDLTR R (SEQ ID: 412) | TSGALT R (SEQ ID: 413) |
| ZFRm 1-4 (right) | GACTTTGCATGT (SEQ ID: 414) | WRSSLAS (SEQ ID: 415) | QSGSLTR (SEQ ID: 416) | HKWVLR Q (SEQ ID: 406) | DRSNLTR (SEQ ID: 407) | | |

TALENs for CIITA were designed to target exon 2 (2L1: gctgaccccctgtgcct (SEQ ID NO: 426); 2L2: gacccctgtgcctct (SEQ ID NO: 427); 2R1: ctccagccaggtccatct (SEQ ID NO: 419); 2R2: tctccagccaggtccat (SEQ ID NO: 420)) and exon 3 (3L1: tcagcaggctgttgt (SEQ ID NO: 421); 3L2: tcagcaggctgttgtgt (SEQ ID NO: 422); 3R1: ccctggtctcttcat (SEQ ID NO: 423); 3R2: aagcctccctggtctt (SEQ ID NO: 424); 3R3: aagcctccctggtct (SEQ ID NO: 425)). The TALENs were constructed using the FastTALE TALEN Assembly Kit (Sidansai), and their activities were confirmed in 293T cells as previously described. The constructed TALENs were transfected into 293T cells and selected with 2 μg/ml puromycin (Sigma). The genomic DNA of 293T cells was harvested after selection. Subsequently, PCR and sequencing were performed to examine the efficiency of the TALENs. The plasmids expressing Cas9 and gRNA were co-transfected into 293T cells with fugene transfection reagent. After 72 hours, 293T cells were collected and the expression of B2m and HLA proteins was detected by flow cytometry.

TABLE 18

Monoclonal sequencing results for ZFNs that target various gene fragments, which are amplified by PCR.

| ZFN | | Number of clones | Number of clones | Mutation |
|---|---|---|---|---|
| Left | Right | analyzed | mutated | frequency |
| ICTZF14L | ICTZF14R | 33 | 10 | 30% |
| ICTZF15L | ICTZF15R | 26 | 3 | 12% |
| ICTZF16L | ICTZF16R | 31 | 7 | 23% |
| ICTZF17L | ICTZF17R | 35 | 3 | 9% |
| ICTZF18L | ICTZF18R | 27 | 6 | 22% |
| ICTZF19L | ICTZF19R | 32 | 9 | 28% |
| ICTZF20L | ICTZF20R | 30 | 1 | 3% |

All publications, patents and patent applications cited in this specification are incorporated herein by reference in their entireties as if each individual publication, patent or patent application were specifically and individually indicated to be incorporated by reference. While the foregoing has been described in terms of various embodiments, the skilled artisan will appreciate that various modifications, substitutions, omissions, and changes may be made without departing from the spirit thereof.

SEQUENCE LISTING (504 sequences)

SEQ ID NO: 1 - protein, 21 aa, Artificial Sequence
  Synthesized
MALPVTALLLPLALLLHAARP

SEQ ID NO: 2 - protein, 69 aa, Artificial Sequence
  Synthesized
AKPTTTPAPRPPTPAPTIASQPLSLRPEACRPAAGGAVHTRGLDFACDIYIWAPLAGTCGVLLLSLVIT

SEQ ID NO: 3 - protein, 42 aa, Artificial Sequence
  Synthesized
KRGRKKLLYIFKQPFMRPVQTTQEEDGCSCRFPEEEEGGCEL

SEQ ID NO: 4 - protein, 112 aa, Artificial Sequence
  Synthesized
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 5 - protein, 242 aa, Artificial Sequence
  Synthesized
DIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGQGTKVEIKGGGGSGGGGSGGGGSEVQLVESGGGLVQPGGSLRLSCAASGVSLPDYGVSWVRQAPGKGLEWVSVIWGSETTYYNSALKSRFTISRDNAKNSLYLQMNSLRAEDTAVYYCAKHYYYGGSYAMDYWGQGTLVTVSS

SEQ ID NO: 6 - protein, 242 aa, Artificial Sequence
  Synthesized
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 7 - protein, 237 aa, Artificial Sequence
  Synthesized
DIQMTQSPASLSVSVGETVTITCRASENIYSNLAWYQQKQGKSPQLLVYVATNLADGVPSRFSGSGSGTQYSLKINSLQSEDFGSYYCQHFWGTPYTFGGGTKLGGGGSGGGGSGGGGSEVQLQQSGAELVKPGASVKLSCTASGFNINDTYMHWVKQRPEQGLEWIGRIDPANGNTKYDPKFQGKATITADTSSNTAYLQLSSLTSEDTAVYYCARGARGSRFAYWGQGTLVTVSA

SEQ ID NO: 8 - protein, 244 aa, Artificial Sequence
  Synthesized
QSVLTQPPSVSAAPGQKVTISCSGSSSDIGSNYVSWYQQFPGTAPKLLIYDNNKRPSAIPDRFSGSKSGTSATLGITGLQTGDEADYYCGTWDSRLGIAVFGGGTQLTVLGGGGSGGGGSGGGGSEVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSS

SEQ ID NO: 9 - protein, 252 aa, Artificial Sequence
  Synthesized
DIVLTQSPASLAVSLGQGATISCRASKSVSTSGYTYMHWYQQKPGQPPKLLIYLASNLESGVPARFSGSGSGTDFTLNIHPVEEEDAATYYCQHSGELPPSFGGGTKLEIKRAGGGGSGGGGSGGGGSEVQLVESGGDLVKPGGSLKLSCAVSGFTFSSYGMSWVRQTPDKRLEWVATVSSGGTYTYYPDSVKGRFTISRDNAKNTLYLQMSSLKSEDSAMYYCARHRGNYYATYYYAMDYWGQGTSVTVSS

SEQ ID NO: 10 - protein, 243 aa, Artificial Sequence
  Synthesized
DVQITQSPSYLAASPGETITINCRASKSISKYLAWYQEKPGKTNKLLIYSGSTLQSGIPSRFSGSGSGTDFTLTISSLEPEDFAMYYCQQHHEYPYTFGGGTKLEIKGGGGSGGGGSGGGGSQVQLQQPGAELVRPGASVKLSCKASGYTFTTYWMNWVKQRPEQGLEWIGRIDPYDSETHYNQKFKDKAILTVDKSSSTAYMQLSSLTSEDSAVYYCARGPYYGTNPWFPYWGQGTLVTVSS

SEQ ID NO: 11 - protein, 241 aa, Artificial Sequence
  Synthesized
EIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKGGGGSGGGGSGGGGSQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSS

SEQ ID NO: 12 - protein, 246 aa, Artificial Sequence
  Synthesized
DVVMTQTPLSLPVRLGDQASISCRSSQSLVHSNGNTYLHWYLQKPGQSPKLLIYKVSNRFSGVPDRFSGSGSGTNFTLKISRVEAEDLGLYFCSQSTHVPYTFGGGTKLEIKRAGGGGSGGGGSGGGGSQVQLRQSGPELVKPGASVKMSCKASGYTFTDYVISWVKQRTGQGLEWIGDIYPGSGYSFYNENFKGKATLTADKSSTTAYMQLSSLTSEDSAVYFCATYYNYPFAYWGQGTLVTVSA

SEQ ID NO: 13 - protein, 199 aa, Artificial Sequence
  Synthesized
LPICPGGAARCQVTLRDLFDRAVVLSHYIHNLSSEMFSEFDKRYTHGRGFITKAINSCHTSSLATPEDKEQAQQMNQKDFLSLIVSILRSWNEPLYHLVTEVRGMQEAPEAILSKAVEIEEQTKRLLEGMELIVSQVHPETKENEIYPVWSGLPSLQMADEESRLSAYYNLLHCLRRDSHKIDNYLKLLKCRIIHNNNC

SEQ ID NO: 14 - protein, 240 aa, Artificial Sequence
  Synthesized
DIVMTQSPDSLAVSLGERATINCKSSQSLLNSRTRKNYLAWYQQKPGQPPKLLIYWASTRESGVPDRFSGSGSGTDFTLTISSLQAEDVAVYYCTQSFILRTFGQGTKVEIKGGGGGSGGGGSGGGGSDIVMTQSPDSLAVSLGERATINCKSSQSLLNSRTRKNYLAWYQQKPGQPPKLLIYWASTRESGVPDRFSGSGSGTDFTLTISSLQAEDVAVYYCTQSFILRTFGQGTKVEIK

SEQ ID NO: 15 - protein, 281 aa, Artificial Sequence
  Synthesized
MNVPTQLLGLLLLWLTGGKCDIQMTQSPASLSASLEEIVTITCKASQAIDAYLSWYQQKPGKSPQLLIYDATSLADGVPSRFSGSRSGTQYSLKISRPQVDDSGIYYCLQSYSTPFTFGSGTKLEIKGGGGGSGGGGSGGGGSMAVLVLLLCLLIFPSCVLSQVQLKESGPGLVQPSQTLSLTCTVSGSSLTSNSVSWIRQPPGKGLEWMGVIWSNGDADYNSAIKSRLSISRDTSKSQVFLKMNSLQTEDTAMYFCASPYYGYYFPFDYWGQGVMVTVSS

SEQ ID NO: 16 - protein, 285 aa, Artificial Sequence
  Synthesized
METDTLLLWVLLLWVPGSTGDIVLTQSPALAVSLGQRATISCRASQSVSISSHDLMQWYQQKPGQQPKLLIYDAFNLASGIPVRFSGSGSGTDFTLTIDPVQADDIATYYCQQSKDDPYTFGAGTKLELKGGGGGSGGGGSGGGGSMDIRLSLAFLVLFIKGVQCEVQLVESGGGLVQPGRSMKLSCAASGFTFSNYGMAWVRQAPTKGLEWVATISYDGSITYYRDSVKGRFTISRDHAKSTLYLQMNSLRSEDTATYYCTREEQYSSWYFDFWGPGIMVTVSS

SEQ ID NO: 17 - protein, 242 aa, Artificial Sequence
  Synthesized
NIVMTQSPSSLSASVGDRVTITCQASQDVGTAVAWYQQKPDQSPKLLIYWTSTRHTGVPDRFTGSGSGTDFTLTISSLQPEDIATYFCHQYNSYNTFGSGTKLEIKGGGGGSGGGGSGGGGSQVTLKESGPVLVKPTETLTLTCTFSGFSLSTSGMGVGWIRQAPGKGLEWVAHIWWDDDVYYNPSLKSRLTITKDASKDQVSLKLSSVTAADTAVYYCVRRRATGTGFDYWGQGTLVTVSS

SEQ ID NO: 18 - protein, 272 aa, Homo sapiens
PEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWK

SEQ ID NO: 19 - protein, 205 aa, Homo sapiens
ISSMDMERPGDGKCQPIEIPMCKDIGYNMTRMPNLMGHENQREAAIQLHEFAPLVEYGCHGHLRFFLCSLYAPMCTEQVSTPIPACRVMCEQARLKCSPIMEQFNFKWPDSLDCRKLPNKNDPNYLCMEAPNNGSDEPTRGSGLFPPLFRPQRPHSAQEHPLKDGGPGRGGCDNPGKFHHVEKSASCAPLCTPGVDVYWSREDKR

SEQ ID NO: 20 - protein, 393 aa, Homo sapiens
GMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMG

SEQ ID NO: 21 - protein, 210 aa, Homo sapiens
QLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMND

SEQ ID NO: 22 - protein, 4368 aa, Homo sapiens
EQDLSVNRAVWDGGGCISQGDVLNRQCQQLSQHVRTGSAANTATGTTSTNVVEPRMYLSCSTNPEMTSIESSVTSDTPGVSSTRMTPTESRTTSESTSDSTTLFPSSTEDTSSPTTPEGTDVPMSTPSEESISSTMAFVSTAPLPSFEAYTSLTYKVDMSTPLTTSTQASSSPTTPESTTIPKSTNSEGSTPLTSMPASTMKVASSEAITLLTTPVEISTPVTISAQASSSPTTAEGPSLSNSAPSGGSTPLTRMPLSVMLVVSSEASTLSTTPAATNIPVITSTEASSSPTTAEGTSIPTSTYTEGSTPLTSTPASTMPVATSEMSTLSITPVDTSTLVTTSTEPSSLPTTAEATSMLTSTLSEGSTPLTNMPVSTILVASSEASTTSTIPVDSKTFVTTASEASSSPTTAEDTSIATSTPSEGSTPLTSMPVSTTPVASSEASNLSTTPVDSKTQVTTSTEASSSPPTAEVNSMPTSTPSEGSTPLTSMSVSTMPVASSEASTLSTTPVDTSTPVTTSSEASSSSTTPEGTSIPTSTPSEGSTPLTNMPVSTRLVVSSEASTTSTTPADSNTFVTTSSEASSSSTTAEGTSMPTSTYSERGTTITSMSVSTTLVASSEASTLSTTPVDSNTPVTTSTEATSSSTTAEGTSMPTSTYTEGSTPLTSMPVNTTLVASSEASTLSTTPVDTSTPVTTSTEASSSPTTADGASMPTSTPSEGSTPLTSMPVSKTLLTSSEASTLSTTPLDTSTHITTSTEASCSPTTTEGTSMPISTPSEGSPLLTSIPVSITPVTSPEASTLSTTPVDSNSPVTTSTEVSSSPTPAEGTSMPTSTYSEGRTPLTSMPVSTTLVATSAISTLSTTPVDTSTPVTNSTEARSSPTTSEGTSMPTSTPGEGSTPLTSMPDSTTPVVSSEARTLSATPVDTSTPVTTSTEATSSPTTAEGTSIPTSTPSEGTTPLTSTPVSHTLVANSEASTLSTTPVDSNTPLTTSTEASSPPPTAEGTSMPTSTPSEGSTPLTRMPVSTTMVASSETSTLSTTPADTSTPVTTYSQASSSSTTADGTSMPTSTYSEGSTPLTSVPVSTRLVVSSEASTLSTTPVDTSIPVTTSTEASSSPTTAEGTSIPTSPPSEGTTPLASMPVSTTLVVSSEANTLSTTPVDSKTQVATSTEASSPPPTAEVTSMPTSTPGERSTPLTSMPVRHTPVASSEASTLSTSPVDTSTPVTTSAETSSSPTTAEGTSLPTSTTSEGSTLLTSIPVSTTLVTSPEASTLLTTPVDTKGPVVTSNEVSSSPTPAEGTSMPTSTYSEGRTPLTSIPVNTTLVASSAISILSTTPVDNSTPVTTSTEACSSPTTSEGTSMPNSNPSEGTTPLTSIPVSTTPVVSSEASTLSATPVDTSTPGTTSAEATSSPTTAEGISIPTSTPSEGKTPLKSIPVSNTPVANSEASTLSTTPVDSNSPVVTSTAVSSSPTPAEGTSIAISTPSEGSTALTSIPVSTTTVASSEINSLSTTPAVTSTPVTTYSQASSSPTTADGTSMQTSTYSEGSTPLTSLPVSTMLVVSSEANTLSTTPIDSKTQVTASTEASSSTTAEGSSMTISTPSEGSPLLTSIPVSTTPVASPEASTLSTTPVDSNSPVITSTEVSSSPTPAEGTSMPTSTYTEGRTPLTSITVRTTPVASSAISTLSTTPVDNSTPVTTSTEARSSPTTSEGTSMPNSTPSEGTTPLTSIPVSTTPVLSSEASTLSATPIDTSTPVTTSTEATSSPTTAEGTSIPTSTLSEGMTPLTSTPVSHTLVANSEASTLSTTPVDSNSPVVTSTAVSSSPTPAEGTSIATSTPSEGSTALTSIPVSTTTVASSETNTLSTTPAVTSTPVTTYAQVSSSPTTADGSSMPTSTPREGRPPLTSIPVSTTTVASSEINTLSTTLADTRTPVTTYSQASSSPTTADGTSMPTPAYSEGSTPLTSMPLSTTLVVSSEASTLSTTPVDTSTPATTSTEGSSSPTTAGGTSIQTSTPSERTTPLAGMPVSTTLVVSSEGNTLSTTPVDSKTQVTNSTEASSSATAEGSSMTISAPSEGSPLLTSIPLSTTPVASPEASTLSTTPVDSNSPVITSTEVSSSPIPTEGTSMQTSTYSDRRTPLTSMPVSTTVVASSAISTLSTTPVDTSTPVTNSTEARSSPTTSEGTSMPTSTPSEGSTPFTSMPVSTMPVVTSEASTLSATPVDTSTPVTTSTEATSSPTTAEGTSIPTSTLSEGTTPLTSIPVSHTLVANSEVSTLSTTPVDSNTPFTTSTEASSPPPTAEGTSMPTSTSSEGNTPLTRMPVSTTMVASFETSTLSTTPADTSTPVTTYSQAGSSPTTADDTSMPTSTYSEGSTPLTSVPVSTMPVVSSEASTHSTTPVDTSTPVTTSTEASSSPTTAEGTSIPTSPPSEGTTPLASMPVSTTPVVSSEAGTLSTTPVDTSTPMTTSTEASSSPTTAEDIVVPISTASEGSTLLTSIPVSTTPVASPEASTLSTTPVDSNSPVVTSTEISSSATSAEGTSMPTSTYSEGSTPLRSMPVSTKPLASSEASTLSTTPVDTSIPVTTSTETSSSPTTAKDTSMPISTPSEVSTSLTSILVSTMPVASSEASTLSTTPVDTRTLVTTSTGTSSSPTTAEGSSMPTSTPGERSTPLTNILVSTTLLANSEASTLSTTPVDTSTPVTTSAEASSSPTTAEGTSMRISTPSDGSTPLTSILVSTLPVASSEASTVSTTAVDTSIPVTTSTEASSSPTTAEVTSMPTSTPSETSTPLTSMPVNHTPVASSEAGTLSTTPVDTSTPVTTSTKASSSPTTAEGIVVPISTASEGSTLLTSIPVSTTPVASSEASTLSTTPVDTSIPVTTSTEGSSSPTTAEGTSMPISTPSEVSTPLTSILVSTVPVAGSEASTLSTTPVDTRTPVTTSAEASSSPTTAEGTSMPISTPGERRTPLTSMSVSTMPVASSEASTLSRTPADTSTPVTTSTEASSSPTTAEGTGIPISTPSEGSTPLTSIPVSTTPVAIPEASTLSTTPVDSNSPVVTSTEVSSSPTPAEGTSMPISTYSEGSTPLTGVPVSTTPVTSSAISTLSTTPVDTSTPVTTSTEAHSSPTTSEGTSMPTSTPSEGSTPLTYMPVSTMLVVSSEDSTLSATPVDTSTPVTTSTEATSSTTAEGTSIPTSTPSEGMTPLTSVPVSNTPVASSEASILSTTPVDSNTPLTTSTEASSSPPTAEGTSMPTSTPSEGSTPLTSMPVSTTTVASSETSTLSTTPADTSTPVTTYSQASSSPPIADGTSMPTSTYSEGSTPLTNMSFSTTPVVSSEASTLSTTPVDTSTPVTTSTEASLSPTTAEGTSIPTSSPSEGTTPLASMPVSTTPVVSSEVNTLSTTPVDSNTLVTTSTEASSSPTIAEGTSLPTSTTSEGSTPLSIMPLSTTPVASSEASTLSTTPVDTSTPVTTSSPTNSSPTTAEVTSMPTSTAGEGSTPLTNMPVSTTPVASSEASTLSTTPVDSNTFVTSSSQASSSPATLQVTTMRMSTPSEGSSSLTTMLLSSTYVTSSEASTPSTPSVDRSTPVTTSTQSNSTPTPPEVITLPMSTPSEVSTPLTIMPVSTTSVTISEAGTASTLPVDTSTPVITSTQVSSSPVTPEGTTMPIWTPSEGSTPLTTMPVSTTRVTSSEGSTLSTPSVVTSTPVTTSTEAISSSATLDSTTMSVSMPMEISTLGTTILVSTTPVTRFPESSTPSIPSVYTSMSMTTASEGSSSPTTLEGTTTMPMSTTSERSTLLTTVLISPISVMSPSEASTLSTPPGDTSTPLLTSTKAGSFSIPAEVTTIRISITSERSTPLTTLLVSTTLPTSFPGASIASTPPLDTSTTFTPSTDTASTPTIPVATTISVSVITEGSTPGTTIFIPSTPVTSSTADVFPATTGAVSTPVITSTELNTPSTSSSSTTTSFSTTKEFTTPAMTTAAPLTYVTMSTAPSTPRTTSRGCTTSASTLSATSTPHTSTSVTTRPVTPSSESSRPSTITSHTIPPTFPPAHSSTPPTTSASSTTVNPEAVTTMTTRTKPSTRTTSFPTVTTTAVPTNTTIKSNPTSTPTVPRTTTCFGDGCQNTASRCKNGGTWDGLKCQCPNLYYGELCEEVVSSIDIGPPETISAQMELTVTVTSVKFTEELKNHSSQEFQEFKQTFTEQMNIVYSGIPEYVGVNITKLRLGSVVVEHDVLLRTKYTPEYKTVLDNATEVVKEKITKVTTQQIMINDICSDMMCFNTTGTQVQNITVTQYDPEEDCRKMAKEYGDYFVVEYRDQKPYCISPCEPGFSVSKNCNLGKCQMSLSGPQCLCVTTETHWYSGETCNQGTQKSLVYG

SEQ ID NO: 23 - protein, 407 aa, Homo sapiens
SQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQ

SEQ ID NO: 24 - protein, 264 aa, Homo sapiens
PRFMGTISDVKTNVQLLKGRVDNISTLDSEIKKNSDGMEAAGVQIQMVNESLGYVRSQFLKLKTSVEKANAQIQILTRSWEEVSTLNAQIPELKSDLEKASALNTKIRALQGSLENMSKLLKRQNDILQVVSQGWKYFKGNFYYFSLIPKTWYSAEQFCVSRNSHLTSVTSESEQEFLYKTAGGLIYWIGLTKAGMEGDWSWVDDTPFNKVQSVRFWIPGEPNNAGNNEHCGNIKAPSLQAWNDAPCDKTFLFICKRPYVPSEP

SEQ ID NO: 25 - protein, 100 aa, Homo sapiens
DGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENC

SEQ ID NO: 26 - protein, 371 aa, Homo sapiens
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQP

SEQ ID NO: 27 - protein, 348 aa, Homo sapiens
RLSWYDPDFQARLTRSNSKCQGQLEVYLKDGWHMVCSQSWGRSSKQWEDPSQASKVCQRLNCGVPLSLGPFLVTYTPQSSIICYGQLGSFSNCSHSRNDMCHSLGLTCLEPQKTTPPTTRPPPTTTPEPTAPPRLQLVAQSGGQHCAGVVEFYSGSLGGTISYEAQDKTQDLENFLCNNLQCGSFLKHLPETEAGRAQDPGEPREHQPLPIQWKIQNSSCTSLEHCFRKIKPQKSGRVLALLCSGFQPKVQSRLVGGSSICEGTVEVRQGAQWAALCDSSSARSSLRWEEVCREQQCGSVNSYRVLDAGDPTSRGLFCPHQKLSQCHELWERNSYCKKVFVTCQDPNP

SEQ ID NO: 28 - DNA, 7902 bp, Artificial Sequence
  Synthesized
gtcgacactagtaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgccgcggaattcgagctcggtacctttaagaccaatgacttacaaggcagctgtagatcttagccactttttaaaagaaaaggggggactggaagggctaattcactcccaacgaagacaagatctgctttttgcttgtactgagtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggctctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacggctctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgatcacgagactagcctcgacacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagaaatccactttggctcgagaagcttgatatcggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggatccgccaccatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcc

SEQ ID NO: 29 - protein, 66 aa, Artificial Sequence
  Synthesized
TTTPAPRPPTPAPTIASQPLSLRPEACRPAAGGAVHTRGLDFACDIYIWAPLAGTCGVLLLSLVIT

SEQ ID NO: 30 - protein, 69 aa, Artificial Sequence
  Synthesized
TTTPAPRPPTPAPTIASQPLSLRPEACRPAAGGAVHTRGLDFACDIYIWAPLAGTCGVLLLSLVITLYC

SEQ ID NO: 31 - protein, 72 aa, Artificial Sequence
  Synthesized
AKPTTTPAPRPPTPAPTIASQPLSLRPEACRPAAGGAVHTRGLDFACDIYIWAPLAGTCGVLLLSLVITLYC

SEQ ID NO: 32 - protein, 69 aa, Artificial Sequence; identical to SEQ ID NO: 2
  Synthesized

SEQ ID NO: 33 - protein, 50 aa, Artificial Sequence
  Synthesized
AKPTTTPAPRPPTPAPTIASQPLSLRPEACRPAAGGAVHTRGLDFACDIY

SEQ ID NO: 34 - protein, 50 aa, Artificial Sequence; identical to SEQ ID NO: 33
  Synthesized

SEQ ID NO: 35 - protein, 47 aa, Artificial Sequence
  Synthesized
TTTPAPRPPTPAPTIASQPLSLRPEACRPAAGGAVHTRGLDFACDIY

SEQ ID NO: 36 - protein, 47 aa, Artificial Sequence; identical to SEQ ID NO: 35
  Synthesized

SEQ ID NO: 37 - protein, 22 aa, Artificial Sequence
  Synthesized
IWAPLAGTCGVLLLSLVITLYC

SEQ ID NO: 38 - protein, 22 aa, Artificial Sequence
  Synthesized
IWAPLAGTCGVLLLSLVITLYC

SEQ ID NO: 39 - protein, 120 aa, Artificial Sequence
  Synthesized
PEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNR

SEQ ID NO: 40 - protein, 19 aa, Artificial Sequence
  Synthesized
IWAPLAGTCGVLLLSLVIT

SEQ ID NO: 41 - DNA, 339 bp, Artificial Sequence
  Synthesized
agagtgaagttcagcaggagcgcagacgcccccgcgtaccagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 42 - DNA, 1689 bp, Artificial Sequence
  Synthesized
cggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggatccgccaccatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 43 - DNA, 1689 bp, Homo sapiens
cggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggatccgccaccatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 44 - DNA, 1689 bp, Artificial Sequence; identical to SEQ ID NO: 42
  Synthesized

SEQ ID NO: 45 - DNA, 1689 bp, Artificial Sequence; identical to SEQ ID NO: 43
  Synthesized

SEQ ID NO: 46 - protein, 106 aa, Artificial Sequence
  Synthesized
NIVMTQSPSSLSASVGDRVTITCQASQDVGTAVAWYQQKPDQSPKLLIYWTSTRHTGVPDRFTGSGSGTDFTLTISSLQPEDIATYFCHQYNSYNTFGSGTKLEIK

SEQ ID NO: 47 - protein, 120 aa, Artificial Sequence
  Synthesized
QVTLKESGPVLVKPTETLTLTCTFSGFSLSTSGMGVGWIRQAPGKGLEWVAHIWWDDDVYYNPSLKSRLTITKDASKDQVSLKLSSVTAADTAVYYCVRRRATGTGFDYWGQGTLVTVSS

SEQ ID NO: 48 - protein, 130 aa, Artificial Sequence
  Synthesized
METDTLLLWVLLLWVPGSTGDIVLTQSPALAVSLGQRATISCRASQSVSISSHDLMQWYQQKPGQQPKLLIYDAFNLASGIPVRFSGSGSGTDFTLTIDPVQADDIATYYCQQSKDDPYTFGAGTKLELK

SEQ ID NO: 49 - protein, 139 aa, Artificial Sequence
  Synthesized
MDIRLSLAFLVLFIKGVQCEVQLVESGGGLVQPGRSMKLSCAASGFTFSNYGMAWVRQAPTKGLEWVATISYDGSITYYRDSVKGRFTISRDHAKSTLYLQMNSLRSEDTATYYCTREEQYSSWYFDFWGPGIMVTVSS

SEQ ID NO: 50 - protein, 112 aa, Artificial Sequence
  Synthesized
DIVMTQSPDSLAVSLGERATINCKSSQSLLNSRTRKNYLAWYQQKPGQPPKLLIYWASTRESGVPDRFSGSGSGTDFTLTISSLQAEDVAVYYCTQSFILRTFGQGTKVEIK

SEQ ID NO: 51 - protein, 119 aa, Artificial Sequence
  Synthesized
EVQLVQSGAEVKKPGASVKVSCKASGYTFTNYYIHWVRQAPGQGLEWIGWIYPGDGNTKYNEKFKGRATLTADTSTSTAYLELSSLRSEDTAVYYCARDSYSNYYFDYWGQGTLVTVSS

SEQ ID NO: 52 - protein, 413 aa, Artificial Sequence
  Synthesized
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMG

SEQ ID NO: 53 - protein, 115 aa, Artificial Sequence
  Synthesized
EVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSS

SEQ ID NO: 54 - protein, 108 aa, Artificial Sequence
  Synthesized
EIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIK

SEQ ID NO: 55 - protein, 140 aa, Artificial Sequence
  Synthesized
MGWSCIILFLVATATGVHSEVQLVESGGGLMQPKGSLKLSCAASGFTFKTYALNWVRQAPGTGLEWVARIRSKSNNYTTYYADSVKDRFTISRDDSQNMLYLQMNNLKTEDTAMYYCVRPQSGTSFAYWGQGTLVTVSAA

SEQ ID NO: 56 - protein, 131 aa, Artificial Sequence
  Synthesized
MGWSCIILFLVATATGVHSNIVLTQSPASLAVSLGQRATISCRASESVDSYGNSFMHWYQQKPGQPPKLLIYLASNLESGVPARFSGSGSRTDFTLTIDPVEADDVATYYCQQNNGDPYTFGGGTKLEIIR

SEQ ID NO: 57 - protein, 120 aa, Artificial Sequence
  Synthesized
QVQLVQSGGGVVQPGKSLRLSCAASGFTFSIFAMHWVRQAPGKGLEWVATISYDGSNAFYADSVEGRFTISRDNSKDSLYLQMDSLRPEDTAVYYCVKAGDGGYDVFDSWGQGTLVTVSS

SEQ ID NO: 58 - protein, 111 aa, Artificial Sequence
  Synthesized
EIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPTFGPGTKVDIK

SEQ ID NO: 59 - DNA, 1473 bp, Artificial Sequence
  Synthesized
atggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 60 - DNA, 1446 bp, Artificial Sequence
  Synthesized
atggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 61 - DNA, 1467 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 62 - DNA, 3533 bp, Artificial Sequence
  Synthesized
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 63 - DNA, 3533 bp, Artificial Sequence
  Synthesized
atggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 64 - DNA, 3545 bp, Artificial Sequence
  Synthesized
atggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 65 - DNA, 3518 bp, Artificial Sequence
  Synthesized
atggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 66 - DNA, 2994 bp, Artificial Sequence
  Synthesized
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagagccacgaacttctctctgttaaagcaagcaggagacgtggaagaaaaccccggtcctcatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 67 - DNA, 2994 bp, Artificial Sequence
  Synthesized
atggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagagccacgaacttctctctgttaaagcaagcaggagacgtggaagaaaaccccggtcctcatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 68 - DNA, 3009 bp, Artificial Sequence
  Synthesized
atggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagagccacgaacttctctctgttaaagcaagcaggagacgtggaagaaaaccccggtcctcatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 69 - DNA, 2982 bp, Artificial Sequence
  Synthesized
atggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagagccacgaacttctctctgttaaagcaagcaggagacgtggaagaaaaccccggtcctcatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 70 - protein, 244 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSS

SEQ ID NO: 71 - protein, 116 aa, Artificial Sequence
  Synthesized
QVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSS

SEQ ID NO: 72 - protein, 113 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELK

SEQ ID NO: 73 - protein, 12 aa, Artificial Sequence
  Synthesized
QSLLNSGDQKNY

SEQ ID NO: 74 - protein, 107 aa, Artificial Sequence
  Synthesized
DIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGQGTKVEIK

SEQ ID NO: 75 - protein, 9 aa, Artificial Sequence
  Synthesized
QNDYSYPLT

SEQ ID NO: 76 - protein, 8 aa, Artificial Sequence
  Synthesized
GYTFTDHA

SEQ ID NO: 77 - protein, 8 aa, Artificial Sequence
  Synthesized
FSPGNTDI

SEQ ID NO: 78 - protein, 9 aa, Artificial Sequence
  Synthesized
KTSTFFFDY

SEQ ID NO: 79 - protein, 246 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSS

SEQ ID NO: 80 - protein, 117 aa, Artificial Sequence
  Synthesized
EVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSS

SEQ ID NO: 81 - protein, 114 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRA

SEQ ID NO: 82 - protein, 16 aa, Artificial Sequence
  Synthesized
RSSKSLLHSNGITYFF

SEQ ID NO: 83 - protein, 7 aa, Artificial Sequence
  Synthesized
QMSNLAS

SEQ ID NO: 84 - protein, 9 aa, Artificial Sequence
  Synthesized
AQNLELPPT

SEQ ID NO: 85 - protein, 5 aa, Artificial Sequence
  Synthesized
NYWMN

SEQ ID NO: 86 - protein, 19 aa, Artificial Sequence
  Synthesized
EIRLKSNNYTTHYAESVKG

SEQ ID NO: 87 - protein, 6 aa, Artificial Sequence
  Synthesized
HYYFDY

SEQ ID NO: 88 - protein, 4 aa, Artificial Sequence
  Synthesized
GSTA

SEQ ID NO: 89 - protein, 97 aa, Artificial Sequence
  Synthesized
CSRAARGTIGARRTGQPLKEDPSAVPVFSVDAGELDFQWREKTPEPPVPCVPEQTEAATIVFPSGMGTSSPARRGSADGPRSAQPLRPEDGHCSWPL

SEQ ID NO: 90 - protein, 17 aa, Artificial Sequence
  Synthesized
CSRAARGTIDGHCSWPL

SEQ ID NO: 91 - protein, 21 aa, Artificial Sequence
  Synthesized
VGVVGGLLGSLVLLVWVLAVI

SEQ ID NO: 92 - protein, 18 aa, Artificial Sequence
  Synthesized
GNILNVSIKICLTLSPST

SEQ ID NO: 93 - protein, 9 aa, Artificial Sequence
  Synthesized
CSRAARGTI

SEQ ID NO: 94 - protein, 80 aa, Artificial Sequence
  Synthesized
GARRTGQPLKEDPSAVPVFSVDYGELDFQWREKTPEPPVPCVPEQTEYATIVFPSGMGTSSPARRGSADGPRSAQPLRPE

SEQ ID NO: 95 - protein, 80 aa, Artificial Sequence; identical to SEQ ID NO: 94
  Synthesized

SEQ ID NO: 96 - protein, 196 aa, Artificial Sequence
  Synthesized
QLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINF

SEQ ID NO: 97 - protein, 196 aa, Artificial Sequence
  Synthesized
QLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVKENQTRNKHINPNEWWKVYPSSVTEFKFLFVSGHFKGNYKAQLTRLNHKTNCNGAVLSVEELLIGGEMIKAGTLTLEEVRRKFNNGEINF

SEQ ID NO: 98 - protein, 196 aa, Artificial Sequence
  Synthesized
QLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMERYVEENQTRNKHLNPNEWWKVYPSSVTEFKFLFVSGHFKGNYKAQLTRLNHITNCNGAVLSVEELLIGGEMIKAGTLTLEEVRRKFNNGEINF

SEQ ID NO: 99 - protein, 323 aa, Artificial Sequence [sequence omitted]

SEQ ID NO: 100 - protein, 127 aa, Artificial Sequence
  Synthesized
MNVPTQLLGLLLLWLTGGKCDIQMTQSPASLSASLEEIVTITCKASQAIDAYLSWYQQKPGKSPQLLIYDATSLADGVPSRFSGSRSGTQYSLKISRPQVDDSGIYYCLQSYSTPFTFGSGTKLEIK

SEQ ID NO: 101 - protein, 184 aa, Homo sapiens
MAPLLPIRTLPLILILLALLSPGAADFNISSLSGLLSPALTESLLVALPPCHLTGGNATLMVRRANDSKVVTSSFVVPPCRGRRELVSVVDSGAGFTVTRLSAYQVTNLVPGTKFYISYLVKKGTATESSREIPMSTLPRRNMESIGLGMARTGGMVVITVLLSVAMFLLVLGFIIALALGSRK

SEQ ID NO: 102 - protein, 909 aa, Homo sapiens
MAARPLPVSPARALLLALAGALLAPCEARGVSLWNQGRADEVVSASVGSGDLWIPVKSFDSKNHPEVLNIRLQRESKELIINLERNEGLIASSFTETHYLQDGTDVSLARNYTVILGHCYYHGHVRGYSDSAVSLSTCSGLRGLIVFENESYVLEPMKSATNRYKLFPAKKLKSVRGSCGSHHNTPNLAAKNVFPPPSQTWARRHKRETLKATKYVELVIVADNREFQRQGKDLEKVKQRLIEIANHVDKFYRPLNIRIVLVGVEVWNDMDKCSVSQDPFTSLHEFLDWRKMKLLPRKSHDNAQLVSGVYFQGTTIGMAPIMSMCTADQSGGIVMDHSDNPLGAAVTLAHELGHNFGMNHDTLDRGCSCQMAVEKGGCIMNASTGYPFPMVFSSCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQADNQGLTIGILVTILCLLAAGFVVYLKRKTLIRLLFTNKKTTIEKLRCVRPSRPPRGFQPCQAHLGHLGKGLMRKPPDSYPPKDNPRRLLQCQNVDISRPLNGLNVPQPQSTQRVLPPLHRAPRAPSVPARPLPAKPALRQAQGTCKPNPPQKPLPADPLARTTRLTHALARTPGQWETGLRLAPLRPAPQYPHQVPRSTHTAYIK

SEQ ID NO: 103 - protein, 553 aa, Homo sapiens
MVQRLWVSRLLRHRKAQLLLVNLLTFGLEVCLAAGITYVPPLLLEVGVEEKFMTMVLGIGPVLGLVCVPLLGSASDHWRGRYGRRRPFIWALSLGILLSLFLIPRAGWLAGLLCPDPRPLELALLILGVGLLDFCGQVCFTPLEALLSDLFRDPDHCRQAYSVYAFMISLGGCLGYLLPAIDWDTSALAPYLGTQEECLFGLLTLIFLTCVAATLLVAEEAALGPTEPAEGLSAPSLSPHCCPCRARLAFRNLGALLPRLHQLCCRMPRTLRRLFVAELCSWMALMTFTLFYTDFVGEGLYQGVPRAEPGTEARRHYDEGVRMGSLGLFLQCAISLVFSLVMDRLVQRFGTRAVYLASVAAFPVAAGATCLSHSVAVVTASAALTGFTFSALQILPYTLASLYHREKQVFLPKYRGDTGGASSEDSLMTSFLPGPKPGAPFPNGHVGAGGSGLLPPPPALCGASACDVSVRVVVGEPTEARVVPGRGICLDLAILDSAFLLSQVAPSLFMGSIVQLSQSVTAYMVSAAGLGLVAIYFATQVVFDKSDLAKYSA

SEQ ID NO: 104 - protein, 418 aa, Homo sapiens
MRAAPLLLARAASLSLGFLFLLFFWLDRSVLAKELKFVTLVFRHGDRSPIDTFPTDPIKESSWPQGFGQLTQLGMEQHYELGEYIRKRYRKFLNESYKHEQVYIRSTDVDRTLMSAMTNLAALFPPEGVSIWNPILLWQPIPVHTVPLSEDQLLYLPFRNCPRFQELESETLKSEEFQKRLHPYKDFIATLGKLSGLHGQDLFGIWSKVYDPLYCESVHNFTLPSWATEDTMTKLRELSELSLLSLYGIHKQKEKSRLQGGVLVNEILNHMKRATQIPSYKKLIMYSAHDTTVSGLQMALDVYNGLLPPYASCHLTELYFEKGEYFVEMYYRNETQHEPYPLMLPGCSPSCPLERFAELVGPVIPQDWSTECMTTNSHQVLKVIFAVAFCLISAVLMVLLFIHIRRGLCWQRESYGNI

SEQ ID NO: 105 - protein, 560 aa, Homo sapiens
MKMQKGNVLLMFGLLLHLEAATNSNETSTSANTGSSVISSGASTATNSGSSVTSSGVSTATISGSSVTSNGVSIVTNSEFHTTSSGISTATNSEFSTVSSGISIATNSESSTTSSGASTATNSESSTPSSGASTATNSDSSTTSSGASTATNSDSSTTSSEASTATNSESSTTSSGASTATNSESSTVSSRASTATNSESSTTSSGASTATNSESRTTSNGAGTATNSESSTTSSGASTATNSESSTPSSGAGTATNSESSTTSSGAGTATNSESSTVSSGISTVTNSESSTPSSGANTATNSESSTTSSGANTATNSDSSTTSSGASTATNSESSTTSSGASTATNSESSTTSSGASTATNSGSSTTSSGTSTATNSESSTVSSGASTATTSESSTTSSGASTATNSESSTVSSGASTATNSESSTTSSGANTATNSGSSVTSAGSGTAALTGMHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMS

SEQ ID NO: 106 - protein, 14507 aa, Homo sapiens
MLKPSGLPGSSSPTRSLMTGSRSTKATPEMDSGLTGATLSPKTSTGAIVVTEHTLPFTSPDKTLASPTSSVVGRTTQSLGVMSSALPESTSRGMTHSEQRTSPSLSPQVNGTPSRNYPATSMVSGLSSPRTRTSSTEGNFTKEASTYTLTVETTSGPVTEKYTVPTETSTTEGDSTETPWDTRYIPVKITSPMKTFADSTASKENAPVSMTPAETTVTDSHTPGRTNPSFGTLYSSFLDLSPKGTPNSRGETSLELILSTTGYPFSSPEPGSAGHSRISTSAPLSSSASVLDNKISETSIFSGQSLTSPLSPGVPEARASTMPNSAIPFSMTLSNAETSAERVRSTISSLGTPSISTKQTAETILTFHAFAETMDIPSTHIAKTLASEWLGSPGTLGGTSTSALTTTSPSTTLVSEETNTHHSTSGKETEGTLNTSMTPLETSAPGEESEMTATLVPTLGFTTLDSKIRSPSQVSSSHPTRELRTTGSTSGRQSSSTAAHGSSDILRATTSSTSKASSWTSESTAQQFSEPQHTQWVETSPSMKTERPPASTSVAAPITTSVPSVVSGFTTLKTSSTKGIWLEETSADTLIGESTAGPTTHQFAVPTGISMTGGSSTRGSQGTTHLLTRATASSETSADLTLATNGVPVSVSPAVSKTAAGSSPPGGTKPSYTMVSSVIPETSSLQSSAFREGTSLGLTPLNTRHPFSSPEPDSAGHTKISTSIPLLSSASVLEDKVSATSTFSHHKATSSITTGTPEISTKTKPSSAVLSSMTLSNAATSPERVRNATSPLTHPSPSGEETAGSVLTLSTSAETTDSPNIHPTGTLTSESSESPSTLSLPSVSGVKTTFSSSTPSTHLFTSGEETEETSNPSVSQPETSVSRVRTTLASTSVPTPVFPTMDTWPTRSAQFSSSHLVSELRATSSTSVTNSTGSALPKISHLTGTATMSQTNRDTFNDSAAPQSTTWPETSPRFKTGLPSATTTVSTSATSLSATVMVSKFTSPATSSMEATSIREPSTTILTTETTNGPGSMAVASTNIPIGKGYITEGRLDTSHLPIGTTASSETSMDFTMAKESVSMSVSPSQSMDAAGSSTPGRTSQFVDTFSDDVYHLTSREITIPRDGTSSALTPQMTATHPPSPDPGSARSTWLGILSSSPSSPTPKVTMSSTFSTQRVTTSMIMDTVETSRWNMPNLPSTTSLTPSNIPTSGAIGKSTLVPLDTPSPATSLEASEGGLPTLSTYPESTNTPSIHLGAHASSESPSTIKLTMASVVKPGSYTPLTFPSIETHIHVSTARMAYSSGSSPEMTAPGETNTGSTWDPTTYITTTDPKDTSSAQVSTPHSVRTLRTTENHPKTESATPAAYSGSPKISSSPNLTSPATKAWTITDTTEHSTQLHYTKLAEKSSGFETQSAPGPVSVVIPTSPTIGSSTLELTSDVPGEPLVLAPSEQTTITLPMATWLSTSLTEEMASTDLDISSPSSPMSTFAIFPPMSTPSHELSKSEADTSAIRNTDSTTLDQHLGIRSLGRTGDLTTVPITPLTTTWTSVIEHSTQAQDTLSATMSPTHVTQSLKDQTSIPASASPSHLTEVYPELGTQGRSSSEATTFWKPSTDTLSREIETGPTNIQSTPPMDNTTTGSSSSGVTLGIAHLPIGTSSPAETSTNMALERRSSTATVSMAGTMGLLVTSAPGRSISQSLGRVSSVLSESTTEGVTDSSKGSSPRLNTQGNTALSSSLEPSYAEGSQMSTSIPLTSSPTTPDVEFIGGSTFWTKEVTTVMTSDISKSSARTESSSATLMSTALGSTENTGKEKLRTASMDLPSPTPSMEVTPWISLTLSNAPNTTDSLDLSHGVHTSSAGTLATDRSLNTGVTRASRLENGSDTSSKSLSMGNSTHTSMTYTEKSEVSSSIHPRPETSAPGAETTLTSTPGNRAISLTLPFSSIPVEEVISTGITSGPDINSAPMTHSPITPPTIVWTSTGTIEQSTQPLHAVSSEKVSVQTQSTPYVNSVAVSASPTHENSVSSGSSTSSPYSSASLESLDSTISRRNAITSWLWDLTTSLPTTTWPSTSLSEALSSGHSGVSNPSSTTTEFPLFSAASTSAAKQRNPETETHGPQNTAASTLNTDASSVTGLSETPVGASISSEVPLPMAITSRSDVSGLTSESTANPSLGTASSAGTKLTRTISLPTSESLVSFRMNKDPWTVSIPLGSHPTTNTETSIPVNSAGPPGLSTVASDVIDTPSDGAESIPTVSFSPSPDTEVTTISHFPEKTTHSFRTISSLTHELTSRVTPIPGDWMSSAMSTKPTGASPSITLGERRTITSAAPTTSPIVLTASFTETSTVSLDNETTVKTSDILDARKTNELPSDSSSSSDLINTSIASSTMDVTKTASISPTSISGMTASSSPSLFSSDRPQVPTSTTETNTATSPSVSSNTYSLDGGSNVGGTPSTLPPFTITHPVETSSALLAWSRPVRTFSTMVSTDTASGENPTSSNSVVTSVPAPGTWTSVGSTTDLPAMGFLKTSPAGEAHSLLASTIEPATAFTPHLSAAVVTGSSATSEASLLTTSESKAIHSSPQTPTTPTSGANWETSATPESLLVVTETSDTTLTSKILVTDTILFSTVSTPPSKFPSTGTLSGASFPTLLPDTPAIPLTATEPTSSLATSFDSTPLVTIASDSLGTVPETTLTMSETSNGDALVLKTVSNPDRSIPGITIQGVTESPLHPSSTSPSKIVAPRNTTYEGSITVALSTLPAGTTGSLVFSQSSENSETTALVDSSAGLERASVMPLTTGSQGMASSGGIRSGSTHSTGTKTFSSLPLTMNPGEVTAMSEITTNRLTATQSTAPKGIPVKPTSAESGLLTPVSASSSPSKAFASLTTAPPTWGIPQSTLTFEFSEVPSLDTKSASLPTPGQSLNTIPDSDASTASSSLSKSPEKNPRARMMTSTKAISASSFQSTGFTETPEGSASPSMAGHEPRVPTSGTGDPRYASESMSYPDPSKASSAMTSTSLASKLTTLFSTGQAARSGSSSSPISLSTEKETSFLSPTASTSRKTSLFLGPSMARQPNILVHLQTSALTLSPTSTLNMSQEEPPELTSSQTIAEEEGTTAETQTLTFTPSETPTSLLPVSSPTEPTARRKSSPETWASSISVPAKTSLVETTDGTLVTTIKMSSQAAQGNSTWPAPAEETGSSPAGTSPGSPEMSTTLKIMSSKEPSISPEIRSTVRNSPWKTPETTVPMETTVEPVTLQSTALGSGSTSISHLPTGTTSPTKSPTENMLATERVSLSPSPPEAWTNLYSGTPGGTRQSLATMSSVSLESPTARSITGTGQQSSPELVSKTTGMEFSMWHGSTGGTTGDTHVSLSTSSNILEDPVTSPNSVSSLTDKSKHKTETWVSTTAIPSTVLNNKIMAAEQQTSRSVDEAYSSTSSWSDQTSGSDITLGASPDVTNTLYITSTAQTTSLVSLPSGDQGITSLTNPSGGKTSSASSVTSPSIGLETLRANVSAVKSDIAPTAGHLSQTSSPAEVSILDVTTAPTPGISTTITTMGTNSISTTTPNPEVGMSTMDSTPATERRTTSTEHPSTWSSTAASDSWTVTDMTSNLKVARSPGTISTMHTTSFLASSTELDSMSTPHGRITVIGTSLVTPSSDASAVKTETSTSERTLSPSDTTASTPISTFSRVQRMSISVPDILSTSWTPSSTEAEDVPVSMVSTDHASTKTDPNTPLSTFLFDSLSTLDWDTGRSLSSATATTSAPQGATTPQELTLETMISPATSQLPFSIGHITSAVTPAAMARSSGVTFSRPDPTSKKAEQTSTQLPTTTSAHPGQVPRSAATTLDVIPHTAKTPDATFQRQGQTALTTEARATSDSWNEKEKSTPSAPWITEMMNSVSEDTIKEVTSSSSVLRTLNTLDINLESGTTSSPSWKSSPYERIAPSESTTDKEAIHPSTNTVETTGWVTSSEHASHSTIPAHSASSKLTSPVVTTSTREQAIVSMSTTTWPESTRARTEPNSFLTIELRDVSPYMDTSSTTQTSIISSPGSTAITKGPRTEITSSKRISSSFLAQSMRSSDSPSEAITRLSNFPAMTESGGMILAMQTSPPGATSLSAPTLDTSATASWTGTPLATTQRFTYSEKTTLFSKGPEDTSQPSPPSVEETSSSSSLVPIHATTSPSNILLTSQGHSPSSTPPVTSVFLSETSGLGKTTDMSRISLEPGTSLPPNLSSTAGEALSTYEASRDTKAIHHSADTAVTNMEATSSEYSPIPGHTKPSKATSPLVTSHIMGDITSSTSVFGSSETTEIETVSSVNQGLQERSTSQVASSATETSTVITHVSSGDATTHVTKTQATFSSGTSISSPHQFITSTNTFTDVSTNPSTSLIMTESSGVTITTQTGPTGAATQGPYLLDTSTMPYLTETPLAVTPDFMQSEKTTLISKGPKDVSWTSPPSVAETSYPSSLTPFLVTTIPPATSTLQGQHTSSPVSATSVLTSGLVKTTDMLNTSMEPVTNSPQNLNNPSNEILATLAATTDIETIHPSINKAVTNMGTASSAHVLHSTLPVSSEPSTATSPMVPASSMGDALASISIPGSETTDIEGEPTSSLTAGRKENSTLQEMNSTTESNIILSNVSVGAITEATKMEVPSFDATFIPTPAQSTKFPDIFSVASSRLSNSPPMTISTHMTTTQTGSSGATSKIPLALDTSTLETSAGTPSVVTEGFAHSKITTAMNNDVKDVSQTNPPFQDEASSPSSQAPVLVTTLPSSVAFTPQWHSTSSPVSMSSVLTSSLVKTAGKVDTSLETVTSSPQSMSNTLDDISVTSAATTDIETTHPSINTVVTNVGTTGSAFESHSTVSAYPEPSKVTSPNVTTSTMEDTTISRSIPKSSKTTRTETETTSSLTPKLRETSISQEITSSTETSTVPYKELTGATTEVSRTDVTSSSSTSFPGPDQSTVSLDISTETNTRLSTSPIMTESAEITITTQTGPHGATSQDTFTMDPSNTTPQAGIHSAMTHGFSQLDVTTLMSRIPQDVSWTSPPSVDKTSSPSSFLSSPAMTTPSLISSTLPEDKLSSPMTSLLTSGLVKITDILRTRLEPVTSSLPNFSSTSDKILATSKDSKDTKEIFPSINTEETNVKANNSGHESHSPALADSETPKATTQMVITTTVGDPAPSTSMPVHGSSETTNIKREPTYFLTPRLRETSTSQESSFPTDTSFLLSKVPTGTITEVSSTGVNSSSKISTPDHDKSTVPPDTFTGEIPRVFTSSIKTKSAEMTITTQASPPESASHSTLPLDTSTTLSQGGTHSTVTQGFPYSEVTTLMGMGPGNVSWMTTPPVEETSSVSSLMSSPAMTSPSPVSSTSPQSIPSSPLPVTALPTSVLVTTTDVLGTTSPESVTSSPPNLSSITHERPATYKDTAHTEAAMHHSTNTAVTNVGTSGSGHKSQSSVLADSETSKATPLMSTTSTLGDTSVSTSTPNISQTNQIQTEPTASLSPRLRESSTSEKTSSTTETNTAFSYVPTGAITQASRTEISSSRTSISDLDRPTIAPDISTGMITRLFTSPIMTKSAEMTVTTQTTTPGATSQGILPWDTSTTLFQGGTHSTVSQGFPHSEITTLRSRTPGDVSWMTTPPVEETSSGFSLMSPSMTSPSPVSSTSPESIPSSPLPVTALLTSVLVTTTNVLGTTSPEPVTSSPPNLSSPTQERLTTYKDTAHTEAMHASMHTNTAVANVGTSISGHESQSSVPADSHTSKATSPMGITFAMGDTSVSTSTPAFFETRIQTESTSSLIPGLRDTRTSEEINTVTETSTVLSEVPTTTTTEVSRTEVITSSRTTISGPDHSKMSPYISTETITRLSTFPFVTGSTEMAITNQTGPIGTISQATLTLDTSSTASWEGTHSPVTQRFPHSEETTTMSRSTKGVSWQSPPSVEETSSPSSPVPLPAITSHSSLYSAVSGSSPTSALPVTSLLTSGRRKTIDMLDTHSELVTSSLPSASSFSGEILTSEASTNTETIHFSENTAETNMGTTNSMHKLHSSVSIHSQPSGHTPPKVTGSMMEDAIVSTSTPGSPETKNVDRDSTSPLTPELKEDSTALVMNSTTESNTVFSSVSLDAATEVSRAEVTYYDPTFMPASAQSTKSPDISPEASSSHSNSPPLTISTHKTIATQTGPSGVTSLGQLTLDTSTIATSAGTPSARTQDFVDSETTSVMNNDLNDVLKTSPFSAEEANSLSSQAPLLVTTSPSPVTSTLQEHSTSSLVSVTSVPTPTLAKITDMDTNLEPVTRSPQNLRNTLATSEATTDTHTMHPSINTAVANVGTTSSPNEFYFTVSPDSDPYKATSAVVITSTSGDSIVSTSMPRSSAMKKIESETTFSLIFRLRETSTSQKIGSSSDTSTVFDKAFTAATTEVSRTELTSSSRTSIQGTEKPTMSPDTSTRSVTMLSTFAGLTKSEERTIATQTGPHRATSQGTLTWDTSITTSQAGTHSAMTHGFSQLDLSTLTSRVPEYISGTSPPSVEKTSSSSSLLSLPAITSPSPVPTTLPESRPSSPVHLTSLPTSGLVKTTDMLASVASLPPNLGSTSHKIPTTSEDIKDTEKMYPSTNIAVTNVGTTTSEKESYSSVPAYSEPPKVTSPMVTSFNIRDTIVSTSMPGSSEITRIEMESTFSLAHGLKGTSTSQDPIVSTEKSAVLHKLTTGATETSRTEVASSRRTSIPGPDHSTESPDISTEVIPSLPISLGITESSNMTIITRTGPPLGSTSQGTFTLDTPTTSSRAGTHSMATQEFPHSEMTTVMNKDPEILSWTIPPSIEKTSFSSSLMPSPAMTSPPVSSTLPKTIHTTPSPMTSLLTPSLVMTTDTLGTSPEPTTSSPPNLSSTSHEILTTDEDTTAIEAMHPSTSTAATNVETTSSGHGSQSSVLADSEKTKATAPMDTTSTMGHTTVSTSMSVSSETTKIKRESTYSLTPGLRETSISQNASFSTDTSIVLSEVPTGTTAEVSRTEVTSSGRTSIPGPSQSTVLPEISTRTMTRLFASPTMTESAEMTIPTQTGPSGSTSQDTLTLDTSTTKSQAKTHSTLTQRFPHSEMTTLMSRGPGDMSWQSSPSLENPSSLPSLLSLPATTSPPPISSTLPVTISSSPLPVTSLLTSSPVTTTDMLHTSPELVTSSPPKLSHTSDERLTTGKDTTNTEAVHPSTNTAASNVEIPSSGHESPSSALADSETSKATSPMFITSTQEDTTVAISTPHFLETSRIQKESISSLSPKLRETGSSVETSSAIETSAVLSEVSIGATTEISRTEVTSSSRTSISGSAESTMLPEISTTRKIIKFPTSPILAESSEMTIKTQTSPPGSTSESTFTLDTSTTPSLVITHSTMTQRLPHSEITTLVSRGAGDVPRPSSLPVEETSPPSSQLSLSAMISPSPVSSTLPASSHSSSASVTSLLTPGQVKTTEVLDASAEPETSSPPSLSSTSVEILATSEVTTDTEKIHPFSNTAVTKVGTSSSGHESPSSVLPDSETTKATSAMGTISIMGDTSVSTLTPALSNTRKIQSEPASSLTTRLRETSTSEETSLATEANTVLSKVSTGATTEVSRTEAISFSRTSMSGPEQSTMSQDISIGTIPRISASSVLTESAKMTITTQTGPSESTLESTLNLNTATTPSWVETHSIVIQGFPHPEMTTSMGRGPGGVSWPSPPFVKETSPPSSPLSLPAVTSPHPVSTTFLAHIPPSPLPVTSLLTSGPATTTDILGTSTEPGTSSSSSLSTTSHERLTTYKDTAHTEAVHPSTNTGGTNVATTSSGYKSQSSVLADSSPMCTTSTMGDTSVLTSTPAFLETRRIQTELASSLTPGLRESSGSEGTSSGTKMSTVLSKVPTGATTEISKEDVTSIPGPAQSTISPDISTRTVSWFSTSPVMTESAEITMNTHTSPLGATTQGTSTLDTSSTTSLTMTHSTISQGFSHSQMSTLMRRGPEDVSWMSPPLLEKTRPSFSLMSSPATTSPSPVSSTLPESISSSPLPVTSLLTSGLAKTTDMLHKSSEPVTNSPANLSSTSVEILATSEVTTDTEKTHPSSNRTVTDVGTSSSGHESTSFVLADSQTSKVTSPMVITSTMEDTSVSTSTPGFFETSRIQTEPTSSLTLGLRKTSSSEGTSLATEMSTVLSGVPTGATAEVSRTEVTSSSRTSISGFAQLTVSPETSTETITRLPTSSIMTESAEMMIKTQTDPPGSTPESTHTVDISTTPNWVETHSTVTQRFSHSEMTTLVSRSPGDMLWPSQSSVEETSSASSLLSLPATTSPSPVSSTLVEDFPSASLPVTSLLNPGLVITTDRMGISREPGTSSTSNLSSTSHERLTTLEDTVDTEDMQPSTHTAVTNVRTSISGHESQSSVLSDSETPKATSPMGTTYTMGETSVSISTSDFFETSRIQIEPTSSLTSGLRETSSSERISSATEGSTVLSEVPSGATTEVSRTEVISSRGTSMSGPDQFTISPDISTEAITRLSTSPIMTESAESAITIETGSPGATSEGTLTLDTSTTTFWSGTHSTASPGFSHSEMTTLMSRTPGDVPWPSLPSVEEASSVSSSLSSPAMTSTSFFSTLPESISSSPHPVTALLTLGPVKTTDMLRTSSEPETSSPPNLSSTSAEILATSEVTKDREKIHPSSNTPVVNVGTVIYKHLSPSSVLADLVTTKPTSPMATTSTLGNTSVSTSTPAFPETMMTQPTSSLTSGLREISTSQETSSATERSASLSGMPTGATTKVSRTEALSLGRTSTPGPAQSTISPEISTETITRISTPLTTTGSAEMTITPKTGHSGASSQGTFTLDTSSRASWPGTHSAATHRSPHSGMTTPMSRGPEDVSWPSRPSVEKTSPPSSLVSLSAVTSPSPLYSTPSESSHSSPLRVTSLFTPVMMKTTDMLDTSLEPVTTSPPSMNITSDESLATSKATMETEAIQLSENTAVTQMGTISARQEFYSSYPGLPEPSKVTSPVVTSSTIKDIVSTTIPASSEITRIEMESTSTLTPTPRETSTSQEIHSATKPSTVPYKALTSATIEDSMTQVMSSSRGPSPDQSTMSQDISTEVITRLSTSPIKTESTEMTITTQTGSPGATSRGTLTLDTSTTFMSGTHSTASQGFSHSQMTALMSRTPGDVPWLSHPSVEEASSASFSLSSPVMTSSSPVSSTLPDSIHSSSLPVTSLLTSGLVKTTELLGTSSEPETSSPPNLSSTSAEILAITEVTTDTEKLEMTNVVTSGYTHESPSSVLADSVTTKATSSMGITYPTGDTNVLTSTPAFSDTSRIQTKSKLSLTPGLMETSISEETSSATEKSTVLSSVPTGATTEVSRTEAISSSRTSIPGPAQSTMSSDTSMETITRISTPLTRKESTDMAITPKTGPSGATSQGTFTLDSSSTASWPGTHSATTQRFPQSVVTTPMSRGPEDVSWPSPLSVEKNSPPSSLVSSSSVTSPSPLYSTPSGSSHSSPVPVTSLFTSIMMKATDMLDASLEPETTSAPNMNITSDESLAASKATTETEAIHVFENTAASHVETTSATEELYSSSPGFSEPTKVISPVVTSSSIRDNMVSTTMPGSSGITRIEIESMSSLTPGLRETRTSQDITSSTETSTVLYKMPSGATPEVSRTEVMPSSRTSIPGPAQSTMSLDISDEVVTRLSTSPIMTESAEITITTQTGYSLATSQVTLPLGTSMTFLSGTHSTMSQGLSHSEMTNLMSRGPESLSWTSPRFVETTRSSSSLTSLPLTTSLSPVSSTLLDSSPSSPLPVTSLILPGLVKTTEVLDTSSEPKTSSSPNLSSTSVEIPATSEIMTDTEKIHPSSNTAVAKVRTSSSVHESHSSVLADSETTITIPSMGITSAVDDTTVFTSNPAFSETRRIPTEPTFSLTPGFRETSTSEETTSITETSAVLYGVPTSATTEVSMTEIMSSNRIHIPDSDQSTMSPDIITEVITRLSSSSMMSESTQMTITTQKSSPGATAQSTLTLATTTAPLARTHSTVPPRFLHSEMTTLMSRSPENPSWKSSLFVEKTSSSSSLLSLPVTTSPSVSSTLPQSIPSSSFSVTSLLTPGMVKTTDTSTEPGTSLSPNLSGTSVEILAASEVTTDTEKIHPSSSMAVTNVGTTSSGHELYSSVSIHSEPSKATYPVGTPSSMAETSISTSMPANFETTGFEAEPFSHLTSGFRKTNMSLDTSSVTPTNTPSSPGSTHLLQSSKTDFTSSAKTSSPDWPPASQYTEIPVDIITPFNASPSITESTGITSFPESRFTMSVTESTHHLSTDLLPSAETISTGTVMPSLSEAMTSFATTGVPRAISGSGSPFSRTESGPGDATLSTIAESLPSSTPVPFSSSTFTTTDSSTIPALHEITSSSATPYRVDTSLGTESSTTEGRLVMVSTLDTSSQPGRTSSSPILDTRMTESVELGTVTSAYQVPSLSTRLTRTDGIMEHITKIPNEAAHRGTIRPVKGPQTSTSPASPKGLHTGGTKRMETTTTALKTTTTALKTTSRATLTTSVYTPTLGTLTPLNASMQMASTIPTEMMITTPYVFPDVPETTSSLATSLGAETSTALPRTTPSVFNRESETTASLVSRSGAERSPVIQTLDVSSSEPDTTASWVIHPAETIPTVSKTTPNFFHSELDTVSSTATSHGADVSSAIPTNISPSELDALTPLVTISGTDTSTTFPTLTKSPHETETRTTWLTHPAETSSTIPRTIPNFSHHESDATPSIATSPGAETSSAIPIMTVSPGAEDLVTSQVTSSGTDRNMTIPTLTLSPGEPKTIASLVTHPEAQTSSAIPTSTISPAVSRLVTSMVTSLAAKTSTTNRALTNSPGEPATTVSLVTHPAQTSPTVPWTTSIFFHSKSDTTPSMTTSHGAESSSAVPTPTVSTEVPGVVTPLVTSSRAVISTTIPILTLSPGEPETTPSMATSHGEEASSAIPTPTVSPGVPGVVTSLVTSSRAVTSTTIPILTFSLGEPETTPSMATSHGTEAGSAVPTVLPEVPGMVTSLVASSRAVTSTTLPTLTLSPGEPETTPSMATSHGAEASSTVPTVSPEVPGVVTSLVTSSSGVNSTSIPTLILSPGELETTPSMATSHGAEASSAVPTPTVSPGVSGVVTPLVTSSRAVTSTTIPILTLSSSEPETTPSMATSHGVEASSAVLTVSPEVPGMVTSLVTSSRAVTSTTIPTLTISSDEPETTTSLVTHSEAKMISAIPTLAVSPTVQGLVTSLVTSSGSETSAFSNLTVASSQPETIDSWVAHPGTEASSVVPTLTVSTGEPFTNISLVTHPAESSSTLPRTTSRFSHSELDTMPSTVTSPEAESSSAISTTISPGIPGVLTSLVTSSGRDISATFPTVPESPHESEATASWVTHPAVTSTTVPRTTPNYSHSEPDTTPSIATSPGAEATSDFPTITVSPDVPDMVTSQVTSSGTDTSITIPTLTLSSGEPETTTSFITYSETHTSSAIPTLPVSPGASKMLTSLVISSGTDSTTTFPTLTETPYEPETTAIQLIHPAETNTMVPRTTPKFSHSKSDTTLPVAITSPGPEASSAVSTTTISPDMSDLVTSLVPSSGTDTSTTFPTLSETPYEPETTATWLTHPAETSTTVSGTIPNFSHRGSDTAPSMVTSPGVDTRSGVPTTTIPPSIPGVVTSQVTSSATDTSTAIPTLTPSPGEPETTASSATHPGTQTGFTVPIRTVPSSEPDTMASWVTHPPQTSTPVSRTTSSFSHSSPDATPVMATSPRTEASSAVLTTISPGAPEMVTSQITSSGAATSTTVPTLTHSPGMPETTALLSTHPRTETSKTFPASTVFPQVSETTASLTIRPGAETSTALPTQTTSSLFTLLVTGTSRVDLSPTASPGVSAKTAPLSTHPGTETSTMIPTSTLSLGLLETTGLLATSSSAETSTSTLTLTVSPAVSGLSSASITTDKPQTVTSWNTETSPSVTSVGPPEFSRTVTGTTMTLIPSEMPTPPKTSHGEGVSPTTILRTTMVEATNLATTGSSPTVAKTTTTFNTLAGSLFTPLTTPGMSTLASESVTSRTSYNHRSWISTTSSYNRRYWTPATSTPVTSTFSPGISTSSIPSSTAATVPFMVPFTLNFTITNLQYEEDMRHPGSRKFNATERELQGLLKPLFRNSSLEYLYSGCRLASLRPEKDSSATAVDAICTHRPDPEDLGLDRERLYWELSNLTNGIQELGPYTLDRNSLYVNGFTHRSSMPTTSTPGTSTVDVGTSGTPSSSPSPTTAGPLLMPFTLNFTITNLQYEEDMRRTGSRKFNTMESVLQGLLKPLFKNTSVGPLYSGCRLTLLRPEKDGAATGVDAICTHRLDPKSPGLNREQLYWELSKLTNDIEELGPYTLDRNSLYVNGFTHQSSVSTTSTPGTSTVDLRTSGTPSSLSSPTIMAAGPLLVPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTSSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGVDREQLYWELSQLTNGIKELGPYTLDRNSLYVNGFTHWIPVPTSSTPGTSTVDLGSGTPSSLPSPTTAGPLLVPFTLNFTITNLKYEEDMHCPGSRKFNTTERVLQSLLGPMFKNTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTTGPLLVPFTLNFTITNLQYEENMGHPGSRKFNITESVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTITNLQYEEDMRRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPMTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGPYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGCRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMQHLLSPLFQRSSLGARYTGCRVIALRSVKNGAETRVDLLCTYLQPLSGPGLPIKQVFHELSQQTHGITRLGPYSLDKDSLYLNGYNEPGPDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGVITCLICGVLVTTRRRKKEGEYNVQQQCPGYYQSHLDLEDLQ

SEQ ID NO: 107 - protein, 267 aa, Homo sapiens
MMSSKPTSHAEVNETIPNPYPPSSFMAPGFQQPLGSINLENQAQGAQRAQPYGITSPGIFASSQPGQGNIQMINPSVGTAVMNFKEEAKALGVIQIMVGLMHIGFGIVLCLISFSFREVLGFASTAVIGGYPFWGGLSFIISGSLSVSASKELSRCLVKGSLGMNIVSSILAFIGVILLLVDMCINGVAGQDYWAVLSGKGISATLMIFSLLEFFVACATAHFANQANTTTNMSVLVIPNMYESNPVTPASSSAPPRCNNYSANAPK

SEQ ID NO: 108 - protein, 535 aa, Homo sapiens
MLGPCMLLLLLLLGLRLQLSLGIIPVEEENPDFWNREAAEALGAAKKLQPAQTAAKNLIIFLGDGMGVSTVTAARILKGQKKDKLGPEIPLAMDRFPYVALSKTYNVDKHVPDSGATATAYLCGVKGNFQTIGLSAAARFNQCNTTRGNEVISVMNRAKKAGKSVGVVTTTRVQHASPAGTYAHTVNRNWYSDADVPASARQEGCQDIATQLISNMDIDVILGGGRKYMFRMGTPDPEYPDDYSQGGTRLDGKNLVQEWLAKRQGARYVWNRTELMQASLDPSVTHLMGLFEPGDMKYEIHRDSTLDPSLMEMTEAALRLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDEETHAGEDVAVFARGPQAHLVHGVQEQTFIAHVMAFAACLEPYTACDLAPPAGTTDAAHPGRSVVPALLPLLAGTLLLLETATAP

SEQ ID NO: 109 - protein, 520 aa, Homo sapiens
MEFHNGGHVSGIGGFLVSLTSRMKPHTLAVTPALIFAITVATIGSFQFGYNTGVINAPETIIKEFINKTLTDKANAPPSEVLLTNLWSLSVAIFSVGGMIGSFSVGLFVNRFGRRNSMLIVNLLAATGGCLMGLCKIAESVEMLILGRLVIGLFCGLCTGFVPMYIGEISPTALRGAFGTLNQLGIVIGILVAQIFGLELILGSEELWPVLLGFTILPAILQSAALPCCPESPRFLLINRKKEENATRILQRLWGTQDVSQDIQEMKDESARMSQEKQVTVLELFRVSSYRQPIIISIVLQLSQQLSGINAVFYYSTGIFKDAGVQQPIYATISAGVVNTIFTLLSLFLVERAGRRTLHMIGLGGMAFCSTLMTVSLLLKNHYNGMSFVCIGAILVFVACFEIGPGPIPWFIVAELFSQGPRPAAMAVAGCSNWTSNFLVGLLFPSAAYYLGAYVFIIFTGFLITFLAFTFFKVPETRGRTFEDITRAFEGQAHGADRSGKDGVMGMNSIEPAKETTTNV

SEQ ID NO: 110 - protein, 221 aa, Homo sapiens
MLTLEDKDMKGFSWAIVPALTSLGYLIILVVSIFPFWVRLTNEESHEVFFSGLFENCFNAKCWKPRPLSIYIILGRVFLLSAVFLAFVTTFIMMPFASEFFPRTWKQNFVLACISFFTGACAFLALVLHALEIKALRMKLGPLQFSVLWPYYVLGFGIFLFIVAGTICLIQEMVCPCWHLLSTSQSMEEDHGSLYLDNLESLGGEPSSVQKETQVTAETVI

SEQ ID NO: 111 - protein, 538 aa, Homo sapiens
MGLLLLVLILTPSLAAYRHPDFPLLEKAQQLLQSTGSPYSTNCWLCTSSSTETPGTAYPASPREWTSIEAELHISYRWDPNLKGLMRPANSLLSTVKQDFPDIRQKPPIFGPIFTNINLMGIAPICVMAKRKNGTNVGTLPSTVCNVTFTVDSNQQTYQTYTHNQFRHQPRFPKPPNITFPQGTLLDKSSRFCQGRPSSCSTRNFWFRPADYNQCLQISNLSSTAEWVLLDQTRNSLFWENKTKGANQSQTPCVQVLAGMTIATSYLGISAVSEFFGTSLTPLFHFHISTCLKTQGAFYICGQSIHQCLPSNWTGTCTIGYVTPDIFIAPGNLSLPIPIYGNSPLPRVRRAIHFIPLLAGLGILAGTGTGIAGITKASLTYSQLSKEIANNIDTMAKALTTMQEQIDSLAAVVLQNRRGLDMLTAAQGGICLALDEKCCFWVNQSGKVQDNIRQLLNQASSLRERATQGWLNWEGTWKWFSWVLPLTGPLVSLLLLLLFGPCLLNLITQFVSSRLQAIKLQTNLSAGRHPRNIQESPF

SEQ ID NO: 112 - protein, 1017 aa, Homo sapiens
MVFSVRQCGHVGRTEEVLLTFKIFLVIICLHVVLVTSLEEDTDNSSLSPPPAKLSVVSFAPSSNGTPEVETTSLNDVTLSLLPSNETEKTKITIVKTFNASGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 113 - protein, 775 aa, Homo sapiens
MEPPYSLTAHYDEFQEVKYVSRCGAGGARGASLPPGFPLGAARSATGARSGLPRWNRREVCLLSGLVFAAGLCAILAAMLALKYLGPVAAGGGACPEGCPERKAFARAARFLAANLDASIDPCQDFYSFACGGWLRRHAIPDDKLTYGTIAAIGEQNEERLRRLLARPGGGPGGAAQRKVRAFFRSCLDMREIERLGPRPMLEVIEDCGGWDLGGAEERPGVAARWDLNRLLYKAQGVYSAAALFSLTVSLDDRNSSRYVIRIDQDGLTLPERTLYLAQDEDSEKILAAYRVFMERVLSLLGADAVEQKAQEILQVEQQLANITVSEHDDLRRDVSSMYNKVTLGQLQKITPHLRWKWLLDQIFQEDFSEEEEVVLLATDYMQQVSQLIRSTPHRVLHNYLVWRVVVVLSEHLSPPFREALHELAQEMEGSDKPQELARVCLGQANRHFGMALGALFVHEHFSAASKAKVQQLVEDIKYILGQRLEELDWMDAETRAAARAKLQYMMVMVGYPDFLLKPDAVDKEYEFEVHEKTYFKNILNSIRFSIQLSVKKIRQEVDKSTWLLPPQALNAYYLPNKNQMVFPAGILQPTLYDPDFPQSLNYGGIGTIIGHELTHGYDDWGGQYDRSGNLLHWWTEASYSRFLRKAECIVRLYDNFTVYNQRVNGKHTLGENIADMGGLKLAYHAYQKWVREHGPEHPLPRLKYTHDQLFFIAFAQNWCIKRRSQSIYLQVLTDKHAPEHYRVLGSVSQFEEFGRAFHCPKDSPMNPAHKCSVW

SEQ ID NO: 114 - protein, 529 aa, Homo sapiens
MGPSCPVFLSFTKLSLWWLLLTPAGGEEAKRPPPRAPGDPLSSPSPTALPQGGSHTETEDRLFKHLFRGYNRWARPVPNTSDVVIVRFGLSIAQLIDVDEKNQMMTTNVWLKQEWSDYKLRWNPTDFGNITSLRVPSEMIWIPDIVLYNNADGEFAVTHMTKAHLFSTGTVHWVPPAIYKSSCSIDVTFFPFDQQNCKMKFGSWTYDKAKIDLEQMEQTVDLKDYWESGEWAIVNATGTYNSKKYDCCAEIYPDVTYAFVIRRLPLFYTINLIIPCLLISCLTVLVFYLPSDCGEKITLCISVLLSLTVFLLLITEIIPSTSLVIPLIGEYLLFTMIFVTLSIVITVFVLNVHHRSPSTHTMPHWVRGALLGCVPRWLLMNRPPPPVELCHPLRLKLSPSYHWLESNVDAEEREVVVEEEDRWACAGHVAPSVGTLCSHGHLHSGASGPKAEALLQEGELLLSPHMQKALEGVHYIADHLRSEDADSSVKEDWKYVAMVIDRIFLWLFIIVCFLGTIGLFLPPFLAGMI

SEQ ID NO: 115 - protein, 537 aa, Homo sapiens
MPHLMERMVGSGLLWLALVSCILTQASAVQRGYGNPIEASSYGLDLDCGAPGTPEAHVCFDPCQNYTLLDEPFRSTENSAGSQGCDKNMSGWYRFVGEGGVRMSETCVQVHRCQTDAPMWLNGTHPALGDGITNHTACAHWSGNCCFWKTEVLVKACPGGYHVYRLEGTPWCNLRYCTVPRDPSTVEDKCEKACRPEEECLALNSTWGCFCRQDLNSSDVHSLQPQLDCGPREIKVKVDKCLLGGLGLGEEVIAYLRDPNCSSILQTEERNWVSVTSPVQASACRNILERNQTHAIYKNTLSLVNDFIIRDTILNINFQCAYPLDMKVSLQAALQPIVSSLNVSVDGNGEFIVRMALFQDQNYTNPYEGDAVELSVESVLYVGAILEQGDTSRFNLVLRNCYATPTEDKADLVKYFIIRNSCSNQRDSTIHVEENGQSSESRFSVQMFMFAGHYDLVFLHCEIHLCDSLNEQCQPSCSRSQVRSEVPAIDLARVLDLGPITRRGAQSPGVMNGTPSTAGFLVAWPMVLLTVLLAWLF

SEQ ID NO: 116 - protein, 426 aa, Homo sapiens
MGPLPAPSCTQRITWKGLLLTASLLNFWNPPTTAEVTIEAQPPKVSEGKDVLLLVHNLPQNLPGYFWYKGEMTDLYHYIISYIVDGKIIIYGPAYSGRETVYSNASLLIQNVTRKDAGTYTLHIIKRGDETREEIRHFTFTLYLETPKPYISSSNLNPREAMEAVRLICDPETLDASYLWWMNGQSLPVTHRLQLSKTNRTLYLFGVTKYIAGPYECEIRNPVSASRSDPVTLNLLPKLPIPYITINNLNPRENKDVLAFTCEPKSENYTYIWWLNGQSLPVSPGVKRPIENRILILPSVTRNETGPYQCEIRDRYGGLRSNPVILNVLYGPDLPRIYPSFTYYRSGENLDLSCFTESNPPAEYFWTINGKFQQSGQKLFIPQITRNHSGLYACSVHNSATGKEISKSMTVKVSGPCHGDLTESQS

SEQ ID NO: 117 - protein, 328 aa, Homo sapiens
MEKSIWLLACLAWVLPTGSFVRTKIDTTENLLNTEVHSSPAQRWSMQVPPEVSAEAGDAAVLPCTFTHPHRHYDGPLTAIWRAGEPYAGPQVFRCAAARGSELCQTALSLHGRFRLLGNPRRNDLSLRVERLALADDRRYFCRVEFAGDVHDRYESRHGVRLHVTAAPRIVNISVLPSPAHAFRALCTAEGEPPPALAWSGPALGNSLAAVRSPREGHGHLVTAELPALTHDGRYTCTAANSLGRSEASVYLFRFHGASGASTVALLLGALGFKALLLLGVLAARAARRRPEHLDTPDTPPRSQAQESNYENLSQMNPRSPPATMCSP

SEQ ID NO: 118 - protein, 620 aa, Homo sapiens
MSKSKCSVGLMSSVVAPAKEPNAVGPKEVELILVKEQNGVQLTSSTLTNPRQSPVEAQDRETWGKKIDFLLSVIGFAVDLANVWRFPYLCYKNGGGAFLVPYLLFMVIAGMPLFYMELALGQFNREGAAGVWKICPILKGVGFTVILISLYVGFFYNVIIAWALHYLFSSFTTELPWIHCNNSWNSPNCSDAHPGDSSGDSSGLNDTFGTTPAAEYFERGVLHLHQSHGIDDLGPPRWQLTACLVLVIVLLYFSLWKGVKTSGKVVWITATMPYVVLTALLLRGVTLPGAIDGIRAYLSVDFYRLCEASVWIDAATQVCFSLGVGFGVLIAFSSYNKFTNNCYRDAIVTTSINSLTSFSSGFVVFSFLGYMAQKHSVPIGDVAKDGPGLIFIIYPEAIATLPLSSAWAVVFFIMLLTLGIDSAMGGMESVITGLIDEFQLLHRHRELFTLFIVLATFLLSLFCVTNGGIYVFTLLDHFAAGTSILFGVLIEAIGVAWFYGVGQFSDDIQQMTGQRPSLYWRLCWKLVSPCFLLFVVVVSIVTFRPPHYGAYIFPDWANALGWVIATSSMAMVPIYAAYKFCSLPGSFREKLAYAIAPEKDRELVDRGEVRQFTLRHWLKV

SEQ ID NO: 119 - protein, 398 aa, Homo sapiens
MHTVATSGPNASWGAPANASGCPGCGANASDGPVPSPRAVDAWLVPLFFAALMLLGLVGNSLVIYVICRHKPMRTVTNFYIANLAATDVTFLLCCVPFTALLYPLPGWVLGDFMCKFVNYIQQVSVQATCATLTAMSVDRWYVTVFPLRALHRRTPRLALAVSLSIWVGSAAVSAPVLALHRLSPGPRAYCSEAFPSRALERAFALYNLLALYLLPLLATCACYAAMLRHLGRVAVRPAPADSALQGQVLAERAGAVRAKVSRLVAAVVLLFAACWGPIQLFLVLQALGPAGSWHPRSYAAYALKTWAHCMSYSNSALNPLLYAFLGSHFRQAFRRVCPCAPRRPRRPRRPGPSDPAAPHAELLRLGSHPAPARAQKPGSSGLAARGLCVLGEDNAPL

SEQ ID NO: 120 - protein, 431 aa, Homo sapiens
MQALNITPEQFSRLLRDHNLTREQFIALYRLRPLVYTPELPGRAKLALVLTGVLIFALALFGNALVFYVVTRSKAMRTVTNIFICSLALSDLLITFFCIPVTMLQNISDNWLGGAFICKMVPFVQSTAVVTEILTMTCIAVERHQGLVHPFKMKWQYTNRRAFTMLGVVWLVAVIVGSPMWHVQQLEIKYDFLYEKEHICCLEEWTSPVHQKIYTTFILVILFLLPLMVMLILYSKIGYELWIKKRVGDGSVLRTIHGKEMSKIARKKKRAVIMMVTVVALFAVCWAPFHVVHMMIEYSNFEKEYDDVTIKMIFAIVQIIGFSNSICNPIVYAFMNENFKKNVLSAVCYCIVNKTFSPAQRHGNSGITMMRKKAKFSLRENPVEETKGEAFSDGNIEVKLCEQTEEKKKLKRHLALFRSELAENSPLDSGH

SEQ ID NO: 121 - protein, 335 aa, Homo sapiens
MESSFSFGVILAVLASLIIATNTLVAVAVLLLIHKNDGVSLCFTLNLAVADTLIGVAISGLLTDQLSSPSRPTQKTLCSLRMAFVTSSAAASVLTVMLITFDRYLAIKQPFRYLKIMSGFVAGACIAGLWLVSYLIGFLPLGIPMFQQTAYKGQCSFFAVFHPHFVLTLSCVGFFPAMLLFVFFYCDMLKIASMHSQQIRKMEHAGAMAGGYRSPRTPSDFKALRTVSVLIGSFALSWTPFLITGIVQVACQECHLYLVLERYLWLLGVGNSLLNPLIYAYWQKEVRLQLYHMALGVKKVLTSFLLFLSARNCGPERPRESSCHIVTISSSEFDG

SEQ ID NO: 122 - protein, 220 aa, Homo sapiens
MASAGMQILGVVLTLLGWVNGLVSCALPMWKVTAFIGNSIVVAQVVWEGLWMSCVVQSTGQMQCKVYDSLLALPQDLQAARALCVIALLVALFGLLVYLAGAKCTTCVEEKDSKARLVLTSGIVFVISGVLTLIPVCWTAHAIIRDFYNPLVAEAQKRELGASLYLGWAASGLLLLGGGLLCCTCPSGGSQGPSHYMARYSTSAPAISRGPSEYPTKNYV

SEQ ID NO: 123 - protein, 21 aa, Homo sapiens
MALPVTALLLPLALLLHAARP

SEQ ID NO: 124 - protein, 15 aa, Homo sapiens
GGGGSGGGGSGGGGS

SEQ ID NO: 125 - protein, 45 aa, Artificial Sequence
  Synthesized
TTTPAPRPPTPAPTIASQPLSLRPEACRPAAGGAVHTRGLDFACD

SEQ ID NO: 126 - protein, 23 aa, Artificial Sequence
  Synthesized
YIWAPLAGTCGVLLLSLVITLYC

SEQ ID NO: 127 - protein, 42 aa, Artificial Sequence; identical to SEQ ID NO: 3
  Synthesized

SEQ ID NO: 128 - protein, 112 aa, Artificial Sequence; identical to SEQ ID NO: 4
  Synthesized

SEQ ID NO: 129 - protein, 485 aa, Artificial Sequence
  Synthesized
MALPVTALLLPLALLLHAARPQIVLTQSPAIMSASLGERVTMTCTASSVVISTYLHWYQQKPGSSPKLWIYSTSNLASGVPVRFSGSGSGTSYSLTISSMEAEDAATYYCHQYHRSPWTFGGGTKLEIKGGGGSGGGGSGGGGSEVQLQQSGPELVKPGGSMKISCKASGYSFTGYTMNWVKQSHGKNLEWIGLINPYNGGISYNQKFKDKATLTMDKSSSTAYMELLSLTSEDSAIYFCARDYRYEGFDYWGQGTLVTVSATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 130 - protein, 241 aa, Artificial Sequence
  Synthesized
QIVLTQSPAIMSASLGERVTMTCTASSVVISTYLHWYQQKPGSSPKLWIYSTSNLASGVPVRFSGSGSGTSYSLTISSMEAEDAATYYCHQYHRSPWTFGGGTKLEIKGGGGSGGGGSGGGGSEVQLQQSGPELVKPGGSMKISCKASGYSFTGYTMNWVKQSHGKNLEWIGLINPYNGGISYNQKFKDKATLTMDKSSSTAYMELLSLTSEDSAIYFCARDYRYEGFDYWGQGTLVTVSA

SEQ ID NO: 131 - protein, 108 aa, Artificial Sequence
  Synthesized
QIVLTQSPAIMSASLGERVTMTCTASSVVISTYLHWYQQKPGSSPKLWIYSTSNLASGVPVRFSGSGSGTSYSLTISSMEAEDAATYYCHQYHRSPWTFGGGTKLEIK

SEQ ID NO: 132 - protein, 118 aa, Artificial Sequence
  Synthesized
EVQLQQSGPELVKPGGSMKISCKASGYSFTGYTMNWVKQSHGKNLEWIGLINPYNGGISYNQKFKDKATLTMDKSSSTAYMELLSLTSEDSAIYFCARDYRYEGFDYWGQGTLVTVSA

SEQ ID NO: 133 - protein, 488 aa, Artificial Sequence
  Synthesized
MALPVTALLLPLALLLHAARPENVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELKGGGGSGGGGSGGGGSEVQLQQSGPELVKPGASVKISCKASGYSFTGYFMNWVKQSHGKSLEWIGRINPYNGDTFYNQKFKGKATLTVDKSSNTAHMELRSLTSEDSAVYYCARVLFLDFDDPYLMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 134 - protein, 244 aa, Artificial Sequence
  Synthesized
ENVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELKGGGGSGGGGSGGGGSEVQLQQSGPELVKPGASVKISCKASGYSFTGYFMNWVKQSHGKSLEWIGRINPYNGDTFYNQKFKGKATLTVDKSSNTAHMELRSLTSEDSAVYYCARVLFLDFDDPYLMDYWGQGTSVTVSS

SEQ ID NO: 135 - protein, 106 aa, Artificial Sequence
  Synthesized
NVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELKE

SEQ ID NO: 136 - protein, 123 aa, Artificial Sequence
  Synthesized
EVQLQQSGPELVKPGASVKISCKASGYSFTGYFMNWVKQSHGKSLEWIGRINPYNGDTFYNQKFKGKATLTVDKSSNTAHMELRSLTSEDSAVYYCARVLFLDFDDPYLMDYWGQGTSVTVSS

SEQ ID NO: 137 - protein, 485 aa, Artificial Sequence
  Synthesized
MALPVTALLLPLALLLHAARPDIQMTQSPASLSASVGETVTITCRASENIDSYLAWYQQKQGKSPQLLVYASTLLVDGVPSRFSGSRSGTQFSLKINSLQSEDVARYYCQHYYSIPYTFGSGTKLEIKGGGGSGGGGSGGGGSEVKLVESGGGLVKPGGSLKLSCAASGFTFNSYTMSWVRQTPAKRLEWVVTISSGGGRTYYPDSVKGRFTISRDNARNTLYLQMSSLRSEDTAMYYCIRGDYRYDGFAYWGQGTLVTVSTTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 138 - protein, 241 aa, Artificial Sequence
  Synthesized
DIQMTQSPASLSASVGETVTITCRASENIDSYLAWYQQKQGKSPQLLVYASTLLVDGVPSRFSGSRSGTQFSLKINSLQSEDVARYYCQHYYSIPYTFGSGTKLEIKGGGGSGGGGSGGGGSEVKLVESGGGLVKPGGSLKLSCAASGFTFNSYTMSWVRQTPAKRLEWVVTISSGGGRTYYPDSVKGRFTISRDNARNTLYLQMSSLRSEDTAMYYCIRGDYRYDGFAYWGQGTLVTVST

SEQ ID NO: 139 - protein, 107 aa, Artificial Sequence
  Synthesized
DIQMTQSPASLSASVGETVTITCRASENIDSYLAWYQQKQGKSPQLLVYASTLLVDGVPSRFSGSRSGTQFSLKINSLQSEDVARYYCQHYYSIPYTFGSGTKLEIK

SEQ ID NO: 140 - protein, 119 aa, Artificial Sequence
  Synthesized
EVKLVESGGGLVKPGGSLKLSCAASGFTFNSYTMSWVRQTPAKRLEWVVTISSGGGRTYYPDSVKGRFTISRDNARNTLYLQMSSLRSEDTAMYYCIRGDYRYDGFAYWGQGTLVTVST

SEQ ID NO: 141 - protein, 488 aa, Artificial Sequence
  Synthesized
MALPVTALLLPLALLLHAARPENVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELKGGGGSGGGGSGGGGSEVQLQQSGPELVKPGASVKISCKASGYSFTGYFMNWVKQSHGKSLEWIGRINPYNGDTFYNQKFKGKATLTVDKSSSTAHMELRSLTSEDSAVYYCARVLFLDFDDPYLMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 142 - protein, 244 aa, Artificial Sequence
  Synthesized
ENVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELKGGGGSGGGGSGGGGSEVQLQQSGPELVKPGASVKISCKASGYSFTGYFMNWVKQSHGKSLEWIGRINPYNGDTFYNQKFKGKATLTVDKSSSTAHMELRSLTSEDSAVYYCARVLFLDFDDPYLMDYWGQGTSVTVSS

SEQ ID NO: 143 - protein, 106 aa, Artificial Sequence
  Synthesized
ENVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELK

SEQ ID NO: 144 - protein, 123 aa, Artificial Sequence
  Synthesized
EVQLQQSGPELVKPGASVKISCKASGYSFTGYFMNWVKQSHGKSLEWIGRINPYNGDTFYNQKFKGKATLTVDKSSSTAHMELRSLTSEDSAVYYCARVLFLDFDDPYLMDYWGQGTSVTVSS

SEQ ID NO: 145 - protein, 482 aa, Artificial Sequence
  Synthesized
MALPVTALLLPLALLLHAARPSSELTQDPAVSVALGQTVRITCRGDSLRKYYASWYQQKPRQAPQLVIYHKNNRASGIPDRFSGSISGNTASLTITGAQAEDEAAYFCNSRDTSGNYLVFGGGTKVTVLGGGGGSGGGGSGGGGSQLQLQESGPGLVKPSETLSLTCAVSGASISNWWSWVRQPPGKGLEWIGEVHHSGVTTYKPSLKSRVTISVDNSKNQLSLKLTSVTAADTAVYYCAREFADDAFDIWGRGTMVTVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 146 - protein, 238 aa, Artificial Sequence
  Synthesized
SSELTQDPAVSVALGQTVRITCRGDSLRKYYASWYQQKPRQAPQLVIYHKNNRASGIPDRFSGSISGNTASLTITGAQAEDEAAYFCNSRDTSGNYLVFGGGTKVTVLGGGGGSGGGGSGGGGSQLQLQESGPGLVKPSETLSLTCAVSGASISNWWSWVRQPPGKGLEWIGEVHHSGVTTYKPSLKSRVTISVDNSKNQLSLKLTSVTAADTAVYYCAREFADDAFDIWGRGTMVTV

SEQ ID NO: 147 - protein, 109 aa, Artificial Sequence
  Synthesized
SSELTQDPAVSVALGQTVRITCRGDSLRKYYASWYQQKPRQAPQLVIYHKNNRASGIPDRFSGSISGNTASLTITGAQAEDEAAYFCNSRDTSGNYLVFGGGTKVTVLG

SEQ ID NO: 148 - protein, 114 aa, Artificial Sequence
  Synthesized
QLQLQESGPGLVKPSETLSLTCAVSGASISNWWSWVRQPPGKGLEWIGEVHHSGVTTYKPSLKSRVTISVDNSKNQLSLKLTSVTAADTAVYYCAREFADDAFDIWGRGTMVTV

SEQ ID NO: 149 - protein, 250 aa, Artificial Sequence
  Synthesized
DIVMTQSPLSLPVTPGEPASISCRSTKSLLHSNGNTYLYWYLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVRQAPGQGLEWMGTIDPETGGTAYNQKFKGRVTITADKSTSTAYMELSSLRSEDTAVYYCTSFYYTYSNYDVGFAYWGQGTLVTVSS

SEQ ID NO: 150 - protein, 250 aa, Artificial Sequence
  Synthesized
DIVMTQSPLSLPVTPGEPASISCRSTKSLLHSNGNTYLYWYLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVRQAPGQGLEWIGTIDPETGGTAYNQKFKGRATLTADRSTSTAYMELSSLRSEDTAVYYCTSFYYTYSNYDVGFAYWGQGTLVTVSS

SEQ ID NO: 151 - protein, 250 aa, Artificial Sequence
  Synthesized
DIVMTQSPLSLPVTPGEPASISCRSTKSLLHSNGNTYLYWYLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVKQAPGQGLEWIGTIDPETGGTAYNQKFKGKATLTADRSTSTAYMELSSLRSEDTAVYYCTSFYYTYSNYDVGFAYWGQGTLVTVSS

SEQ ID NO: 152 - protein, 250 aa, Artificial Sequence
  Synthesized
DIVMTQSPLSLPVTPGEPASISCRSTKSLLHSNGNTYLYWYLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVKQAPGHGLEWIGTIDPETGGTAYNQKFKGKATLTADRSTSTAYMELSSLTSEDTAVYYCTSFYYTYSNYDVGFAYWGQGTLVTVSS

SEQ ID NO: 153 - protein, 250 aa, Artificial Sequence
  Synthesized
DIVMTQSPLSLPVTPGEPASISCRSTKSLLHSNGNTYLYWFLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVRQAPGQGLEWMGTIDPETGGTAYNQKFKGRVTITADKSTSTAYMELSSLRSEDTAVYYCTSFYYTYSNYDVGFAYWGQGTLVTVSS

SEQ ID NO: 154 - protein, 250 aa, Artificial Sequence
  Synthesized
DIVMTQSPLSLPVTPGEPASISCRSTKSLLHSNGNTYLYWFLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVRQAPGQGLEWIGTIDPETGGTAYNQKFKGRATLTADRSTSTAYMELSSLRSEDTAVYYCTSFYYTYSNYDVGFAYWGQGTLVTVSS

SEQ ID NO: 155 - protein, 250 aa, Artificial Sequence
  Synthesized
DIVMTQSPLSLPVTPGEPASISCRSTKSLLHSNGNTYLYWFLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVKQAPGQGLEWIGTIDPETGGTAYNQKFKGKATLTADRSTSTAYMELSSLRSEDTAVYYCTSFYYTYSNYDVGFAYWGQGTLVTVSS

SEQ ID NO: 156 - protein, 250 aa, Artificial Sequence
  Synthesized
DIVMTQSPLSLPVTPGEPASISCRSTKSLLHSNGNTYLYWFLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVKQAPGHGLEWIGTIDPETGGTAYNQKFKGKATLTADRSTSTAYMELSSLTSEDTAVYYCTSFYYTYSNYDVGFAYWGQGTLVTVSS

SEQ ID NO: 157 - protein, 112 aa, Artificial Sequence
  Synthesized
DIVMTQSPLSLPVTPGEPASISCRSTKSLLHSNGNTYLYWYLQKPGQSPQLLIYRMSNLASGVPDRFSGSGSGTDFTLKISRVEAEDVGVYYCMQHLEYPFTFGGGTKVEIK

SEQ ID NO: 158 - protein, 112 aa, Artificial Sequence
  Synthesized
DIVMTQSPLSLPVTPGEPASISCRSTKSLLHSNGNTYLYWFLQKPGQSPQLLIYRMSNLASGVPDRFSGSGSGTDFTLKISRVEAEDVGVYYCMQHLEYPFTFGGGTKVEIK

SEQ ID NO: 159 - protein, 123 aa, Artificial Sequence
  Synthesized
EIQLQQSGAEVKKPGSSVKVSCKASGYTFTDYDMHWVRQAPGQGLEWMGTIDPETGGTAYNQKFKGRVTITADKSTSTAYMELSSLRSEDTAVYYCTSFYYTYSNYDVGFAYWGQGTLVTVSS

SEQ ID NO: 160 - protein, 123 aa, Artificial Sequence
  Synthesized
EIQLQQSGAEVKKPGSSVKVSCKASGYTFTDYDMHWVRQAPGQGLEWIGTIDPETGGTAYNQKFKGRATLTADRSTSTAYMELSSLRSEDTAVYYCTSFYYTYSNYDVGFAYWGQGTLVTVSS

SEQ ID NO: 161 - protein, 123 aa, Artificial Sequence
  Synthesized
EIQLQQSGAEVKKPGSSVKVSCKASGYTFTDYDMHWVKQAPGQGLEWIGTIDPETGGTAYNQKFKGKATLTADRSTSTAYMELSSLRSEDTAVYYCTSFYYTYSNYDVGFAYWGQGTLVTVSS

SEQ ID NO: 162 - protein, 123 aa, Artificial Sequence
  Synthesized
EIQLQQSGAEVKKPGSSVKVSCKASGYTFTDYDMHWVKQAPGHGLEWIGTIDPETGGTAYNQKFKGKATLTADRSTSTAYMELSSLTSEDTAVYYCTSFYYTYSNYDVGFAYWGQGTLVTVSS

SEQ ID NO: 163 - protein, 482 aa, Artificial Sequence
  Synthesized
MALPVTALLLPLALLLHAARPDIQMTQSPSSLSASVGDRVTITCKASDLIHNWLAWYQQKPGKAPKLLIYGATSLETGVPSRFSGSGSGTDFTLTISSLQPEDFATYYCQQYWTTPFTFGQGTKVEIKGGGGSGGGGSGGGGSEVQLVESGGGLVQPGGSLRLSCAASGYSITNDYAWNWVRQAPGKGLEWVGYISYSGYTTYNPSLKSRFTISRDTSKNTLYLQMNSLRAEDTAVYYCARWTSGLDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 164 - protein, 238 aa, Artificial Sequence
  Synthesized
DIQMTQSPSSLSASVGDRVTITCKASDLIHNWLAWYQQKPGKAPKLLIYGATSLETGVPSRFSGSGSGTDFTLTISSLQPEDFATYYCQQYWTTPFTFGQGTKVEIKGGGGSGGGGSGGGGSEVQLVESGGGLVQPGGSLRLSCAASGYSITNDYAWNWVRQAPGKGLEWVGYISYSGYTTYNPSLKSRFTISRDTSKNTLYLQMNSLRAEDTAVYYCARWTSGLDYWGQGTLVTVSS

SEQ ID NO: 165 - protein, 107 aa, Artificial Sequence
  Synthesized
DIQMTQSPSSLSASVGDRVTITCKASDLIHNWLAWYQQKPGKAPKLLIYGATSLETGVPSRFSGSGSGTDFTLTISSLQPEDFATYYCQQYWTTPFTFGQGTKVEIK

SEQ ID NO: 166 - protein, 116 aa, Artificial Sequence
  Synthesized
EVQLVESGGGLVQPGGSLRLSCAASGYSITNDYAWNWVRQAPGKGLEWVGYISYSGYTTYNPSLKSRFTISRDTSKNTLYLQMNSLRAEDTAVYYCARWTSGLDYWGQGTLVTVSS

SEQ ID NO: 167 - protein, 482 aa, Artificial Sequence
  Synthesized
MALPVTALLLPLALLLHAARPDIQMTQSSSFLSVSLGGRVTITCKASDLIHNWLAWYQQKPGNAPRLLISGATSLETGVPSRFSGSGSGNDYTLSIASLQTEDAATYYCQQYWTTPFTFGSGTKVEIKGGGGSGGGGSGGGGSDVQLQESGPGLVNPSQSLSLTCTVTGYSITNDYAWNWIRQFPGNKLEWMGYINYSGYTTYNPSLKSRISITRDTSKNQFFLHLNSVTTEDTATYYCARWDGGLTYWGQGTLVTVSATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 168 - protein, 238 aa, Artificial Sequence
  Synthesized
DIQMTQSSSFLSVSLGGRVTITCKASDLIHNWLAWYQQKPGNAPRLLISGATSLETGVPSRFSGSGSGNDYTLSIASLQTEDAATYYCQQYWTTPFTFGSGTKVEIKGGGGSGGGGSGGGGSDVQLQESGPGLVNPSQSLSLTCTVTGYSITNDYAWNWIRQFPGNKLEWMGYINYSGYTTYNPSLKSRISITRDTSKNQFFLHLNSVTTEDTATYYCARWDGGLTYWGQGTLVTVSA

SEQ ID NO: 169 - protein, 107 aa, Artificial Sequence
  Synthesized
DIQMTQSSSFLSVSLGGRVTITCKASDLIHNWLAWYQQKPGNAPRLLISGATSLETGVPSRFSGSGSGNDYTLSIASLQTEDAATYYCQQYWTTPFTFGSGTKVEIK

SEQ ID NO: 170 - protein, 116 aa, Artificial Sequence
  Synthesized
DVQLQESGPGLVNPSQSLSLTCTVTGYSITNDYAWNWIRQFPGNKLEWMGYINYSGYTTYNPSLKSRISITRDTSKNQFFLHLNSVTTEDTATYYCARWDGGLTYWGQGTLVTVSA

SEQ ID NO: 171 - protein, 298 aa, Artificial Sequence
  Synthesized
MALPVTALLLPLALLLHAARPGTSLSPPPESSGSPQQPGLSAPHSRQIPAPQGAVLVQREKDLPNYNWNSFGLRFTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 172 - protein, 54 aa, Artificial Sequence
  Synthesized
GTSLSPPPESSGSPQQPGLSAPHSRQIPAPQGAVLVQREKDLPNYNWNSFGLRF

SEQ ID NO: 173 - protein, 19 aa, Artificial Sequence
  Synthesized
GTTGCTCCAGGCCACAGCA

SEQ ID NO: 174 - protein, 7 aa, Artificial Sequence
  Synthesized
QSGDLTR

SEQ ID NO: 175 - protein, 7 aa, Artificial Sequence
  Synthesized
QWGTRYR

SEQ ID NO: 176 - protein, 7 aa, Artificial Sequence
  Synthesized
ERGTLAR

SEQ ID NO: 177 - protein, 7 aa, Artificial Sequence
  Synthesized
RSDNLRE

SEQ ID NO: 178 - protein, 7 aa, Artificial Sequence
  Synthesized
QSGDLTR

SEQ ID NO: 179 - protein, 7 aa, Artificial Sequence
  Synthesized
TSGALTR

SEQ ID NO: 180 - protein, 12 aa, Artificial Sequence
  Synthesized
GACTTTGCATGT

SEQ ID NO: 181 - protein, 7 aa, Artificial Sequence
  Synthesized
WRSSLAS

SEQ ID NO: 182 - protein, 7 aa, Artificial Sequence
  Synthesized
QSGSLTR

SEQ ID NO: 183 - protein, 7 aa, Artificial Sequence
  Synthesized
HKWVLRQ

SEQ ID NO: 184 - protein, 7 aa, Artificial Sequence
  Synthesized
DRSNLTR

SEQ ID NO: 185 - protein, 293 aa, Artificial Sequence
  Synthesized
MQRISSLIHLSLFWAGVMSAIELVPEHQTVPVSIGVPATLRCSMKGEAIGNYYINWYRKTQGNTITFIYREKDIYGPGFKDNFQGDIDIAKNLAVLKILAPSERDEGSYYCACDTMGHPRGKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFLTRDC

SEQ ID NO: 186 - protein, 315 aa, Artificial Sequence
  Synthesized
MVSLLHASTLAVLGALCVYGAGHLEQPQISSTKTLSKTARLECVVSGITISATSVYWYRERPGEVIQFLVSISYDGTVRKESGIPSGKFEVDRIPETSTSTLTIHNVEKQDIATYYCALWEAQQELGKKIKVFGPGTKLIITDKQLDADVSPKPTIFLPSIAETKLQKAGTYLCLLEKFFPDVIKIHWEEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 187 - protein, 292 aa, Artificial Sequence
  Synthesized
MERISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDTLGMGGEYTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 188 - protein, 313 aa, Artificial Sequence
  Synthesized
MVSLLHASTLAVLGALCVYGAGHLEQPQISSTKTLSKTARLECVVSGITISATSVYWYRERPGEVIQFLVSISYDGTVRKESGIPSGKFEVDRIPETSTSTLTIHNVEKQDIATYYCALWEWELGKKIKVFGPGTKLIITDKQLDADVSPKPTIFLPSIAETKLQKAGTYLCLLEKFFPDVIKIHWEEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 189 - protein, 288 aa, Artificial Sequence
  Synthesized
MERISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDTLVSTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 190 - protein, 314 aa, Artificial Sequence
  Synthesized
MVSLLHASTLAVLGALCVYGAGHLEQPQISSTKTLSKTARLECVVSGITISATSVYWYRERPGEVIQFLVSISYDGTVRKESGIPSGKFEVDRIPETSTSTLTIHNVEKQDIATYYCALWEVGELGKKIKVFGPGTKLIITDKQLDADVSPKPTIFLPSIAETKLQKAGTYLCLLEKFFPDVIKIHWEEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 191 - protein, 291 aa, Artificial Sequence
  Synthesized
MERISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDTVAHGGGTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 192 - protein, 313 aa, Artificial Sequence; identical to SEQ ID NO: 188
  Synthesized

SEQ ID NO: 193 - protein, 291 aa, Artificial Sequence
  Synthesized
MERISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDNLSTGGYTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 194 - protein, 316 aa, Artificial Sequence
  Synthesized
MVSLLHASTLAVLGALCVYGAGHLEQPQISSTKTLSKTARLECVVSGITISATSVYWYRERPGEVIQFLVSISYDGTVRKESGIPSGKFEVDRIPETSTSTLTIHNVEKQDIATYYCALWEVYQGELGKKIKVFGPGTKLIITDKQLDADVSPKPTIFLPSIAETKLQKAGTYLCLLEKFFPDVIKIHWEEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 195 - protein, 291 aa, Artificial Sequence
  Synthesized
MERISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDILGEKPYTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 196 - DNA, 339 bp, Artificial Sequence; identical to SEQ ID NO: 41
  Synthesized

SEQ ID NO: 197 - protein, 276 aa, Artificial Sequence
  Synthesized
MKKHLTTFLVILWLYFYRGNGKNQVEQSPQSLIILEGKNCTLQCNYTVSPFSNLRWYKQDTGRGPVSLTIMTFSENTKSNGRYTATLDADTKQSSLHITASQLSDSASYICVVSDRGSTLGRLYFGRGTQLTVWPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 198 - protein, 313 aa, Artificial Sequence
  Synthesized
MTIRLLCYVGFYFLGAGLMEADIYQTPRYLVIGTGKKITLECSQTMGHDKMYWYQQDPGMELHLIHYSYGVNSTEKGDLSSESTVSRIRTEHFPLTLESARPSHTSQYLCASSGLRDRGLYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 199 - protein, 267 aa, Artificial Sequence
  Synthesized
MWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVKDSNYQLIWGAGTKLIIKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 200 - protein, 138 aa, Artificial Sequence
  Synthesized
MAVLVLLLCLLIFPSCVLSQVQLKESGPGLVQPSQTLSLTCTVSGSSLTSNSVSWIRQPPGKGLEWMGVIWSNGDADYNSAIKSRLSISRDTSKSQVFLKMNSLQTEDTAMYFCASPYYGYYFPFDYWGQGVMVTVSS

SEQ ID NO: 201 - DNA, 3533 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 202 - protein, 488 aa, Artificial Sequence
  Synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 203 - protein, 486 aa, Artificial Sequence
  Synthesized
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 204 - DNA, 3524 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 205 - protein, 485 aa, Artificial Sequence
  Synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 206 - DNA, 3524 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 207 - protein, 483 aa, Artificial Sequence
  Synthesized
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 208 - DNA, 3515 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 209 - DNA, 3533 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 210 - protein, 490 aa, Artificial Sequence
  Synthesized
MALPVTALLLPLALLLHAARPDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 211 - DNA, 3524 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 212 - protein, 487 aa, Artificial Sequence
  Synthesized
MALPVTALLLPLALLLHAARPDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 213 - DNA, 3524 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 214 - DNA, 3515 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 215 - DNA, 3533 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 216 - protein, 486 aa, Artificial Sequence
  Synthesized
MALPVTALLLPLALLLHAARPDIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGQGTKVEIKGGGGSGGGGSGGGGSEVQLVESGGGLVQPGGSLRLSCAASGVSLPDYGVSWVRQAPGKGLEWVSVIWGSETTYYNSALKSRFTISRDNAKNSLYLQMNSLRAEDTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 217 - DNA, 3524 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 218 - DNA, 3524 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 219 - protein, 483 aa, Artificial Sequence
  Synthesized
MALPVTALLLPLALLLHAARPDIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGQGTKVEIKGGGGSGGGGSGGGGSEVQLVESGGGLVQPGGSLRLSCAASGVSLPDYGVSWVRQAPGKGLEWVSVIWGSETTYYNSALKSRFTISRDNAKNSLYLQMNSLRAEDTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 220 - DNA, 3515 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 221 - DNA, 3533 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 222 - DNA, 3524 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 223 - DNA, 3524 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 224 - DNA, 3515 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 225 - DNA, 3545 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 226 - protein, 490 aa, Artificial Sequence
  Synthesized
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 227 - DNA, 3536 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 228 - DNA, 3536 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 229 - protein, 487 aa, Artificial Sequence
  Synthesized
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 230 - DNA, 3527 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 231 - DNA, 3545 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 232 - DNA, 3536 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 233 - DNA, 3536 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 234 - DNA, 3527 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 235 - DNA, 3665 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 236 - protein, 530 aa, Artificial Sequence
  Synthesized
MALPVTALLLPLALLLHAARPMGWSCIILFLVATATGVHSNIVLTQSPASLAVSLGQRATISCRASESVDSYGNSFMHWYQQKPGQPPKLLIYLASNLESGVPARFSGSGSRTDFTLTIDPVEADDVATYYCQQNNGDPYTFGGGTKLEIIRGGGGSGGGGSGGGGSMGWSCIILFLVATATGVHSEVQLVESGGGLMQPKGSLKLSCAASGFTFKTYALNWVRQAPGTGLEWVARIRSKSNNYTTYYADSVKDRFTISRDDSQNMLYLQMNNLKTEDTAMYYCVRPQSGTSFAYWGQGTLVTVSAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 237 - DNA, 3656 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 238 - DNA, 3656 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 239 - protein, 527 aa, Artificial Sequence
  Synthesized
MALPVTALLLPLALLLHAARPMGWSCIILFLVATATGVHSNIVLTQSPASLAVSLGQRATISCRASESVDSYGNSFMHWYQQKPGQPPKLLIYLASNLESGVPARFSGSGSRTDFTLTIDPVEADDVATYYCQQNNGDPYTFGGGTKLEIIRGGGGSGGGGSGGGGSMGWSCIILFLVATATGVHSEVQLVESGGGLMQPKGSLKLSCAASGFTFKTYALNWVRQAPGTGLEWVARIRSKSNNYTTYYADSVKDRFTISRDDSQNMLYLQMNNLKTEDTAMYYCVRPQSGTSFAYWGQGTLVTVSAATTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 240 - DNA, 3665 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 241 - DNA, 3656 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 242 - DNA, 3656 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 243 - DNA, 3647 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 244 - DNA, 3518 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 245 - protein, 482 aa, Artificial Sequence
  Synthesized
MALPVTALLLPLALLLHAARPEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKGGGGSGGGGSGGGGSEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 246 - DNA, 3509 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 247 - DNA, 3509 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 248 - protein, 479 aa, Artificial Sequence
  Synthesized
MALPVTALLLPLALLLHAARPEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKGGGGSGGGGSGGGGSEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 249 - DNA, 3500 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 250 - DNA, 3518 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 251 - DNA, 3509 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 252 - DNA, 3509 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 253 - DNA, 3500 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 254 - DNA, 3545 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 255 - protein, 490 aa, Artificial Sequence
  Synthesized
MALPVTALLLPLALLLHAARPEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPTFGPGTKVDIKGGGGSGGGGSGGGGSQVQLVQSGGGVVQPGKSLRLSCAASGFTFSIFAMHWVRQAPGKGLEWVATISYDGSNAFYADSVEGRFTISRDNSKDSLYLQMDSLRPEDTAVYYCVKAGDGGYDVFDSWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 256 - DNA, 3536 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 257 - DNA, 3536 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 258 - protein, 487 aa, Artificial Sequence
  Synthesized
MALPVTALLLPLALLLHAARPEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPTFGPGTKVDIKGGGGSGGGGSGGGGSQVQLVQSGGGVVQPGKSLRLSCAASGFTFSIFAMHWVRQAPGKGLEWVATISYDGSNAFYADSVEGRFTISRDNSKDSLYLQMDSLRPEDTAVYYCVKAGDGGYDVFDSWGQGTLVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 259 - DNA, 3527 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 260 - DNA, 3545 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 261 - DNA, 3536 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 262 - DNA, 3536 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 263 - DNA, 3527 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 264 - protein, 505 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSS

SEQ ID NO: 265 - protein, 505 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSS

SEQ ID NO: 266 - protein, 69 aa, Artificial Sequence; identical to SEQ ID NO: 30
  Synthesized

SEQ ID NO: 267 - protein, 66 aa, Artificial Sequence; identical to SEQ ID NO: 29
  Synthesized

SEQ ID NO: 268 - protein, 69 aa, Artificial Sequence; identical to SEQ ID NO: 2
  Synthesized

SEQ ID NO: 269 - protein, 72 aa, Artificial Sequence; identical to SEQ ID NO: 31
  Synthesized

SEQ ID NO: 270 - protein, 728 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 271 - protein, 725 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 272 - protein, 728 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSAKPTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 273 - protein, 731 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 274 - protein, 728 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 275 - protein, 725 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 276 - protein, 728 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSAKPTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 277 - protein, 731 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 278 - protein, 5 aa, Artificial Sequence
  Synthesized
GGGGS

SEQ ID NO: 279 - DNA, 1470 bp, Artificial Sequence
  Synthesized
atggccttaccagtgaccgccttgctcctgccgctggccttgctgctccacgccgccaggccgcagtccgtgctgacccagccaccttccgtgtctgccgctccaggccagaaggtgacaatcagctgctccggcagctcctctgacatcggaagcaactacgtgtcctggtaccagcagttcccaggcaccgcccccaagctgctgatctacgacaacaacaagaggcctagcgccatcccagatagattttctggcagcaagtccggaacctccgccacactgggcatcaccggactgcagacaggcgacgaggctgattactactgcggcacatgggattccaggctgggaatcgccgtgttcggaggaggaacccagctgacagtgctgggcggaggaggaggaagcggaggaggaggatccggaggaggaggatctgaggtgcagctggtgcagtctggcgccgaggtgaagaagcctggacagtctctgaagatcagctgtaaggcttccggctactctctgaccgacaactggatcggatgggtgcggcagaagccaggcaagggactggagtggatgggcatcatctacccaggagactctgatacacgctactctcccagctttcagggccaggtgaccatctccgccgataagtctatcaacacagcttacctgcagtggagctccctgaaggccagcgacaccgctatctactactgcgtgggcctggattggaactacaacccactgaggtactggggacctggaaccctggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 280 - protein, 196 aa, Artificial Sequence; identical to SEQ ID NO: 97
  Synthesized

SEQ ID NO: 281 - protein, 196 aa, Artificial Sequence; identical to SEQ ID NO: 98
  Synthesized

SEQ ID NO: 282 - protein, 196 aa, Flavobacterium ameridies; identical to SEQ ID NO: 96

SEQ ID NO: 283 - DNA, 24 bp, Homo sapiens
ggctcctgctgcatcgtagctgct

SEQ ID NO: 284 - protein, 7 aa, Artificial Sequence
  Synthesized
QRASLTR

SEQ ID NO: 285 - DNA, 24 bp, Homo sapiens
agctgccccttcgcggacgtggcc

SEQ ID NO: 286 - protein, 7 aa, Artificial Sequence
  Synthesized
DRSNLTR

SEQ ID NO: 287 - protein, 7 aa, Artificial Sequence
  Synthesized
RSDALSR

SEQ ID NO: 288 - protein, 7 aa, Artificial Sequence
  Synthesized
ERGTLAR

SEQ ID NO: 289 - DNA, 24 bp, Homo sapiens
tgccgcccctactgtggagatgga

SEQ ID NO: 290 - protein, 7 aa, Artificial Sequence
  Synthesized
TSGNLVR

SEQ ID NO: 291 - protein, 7 aa, Artificial Sequence
  Synthesized
QSGHLAR

SEQ ID NO: 292 - protein, 7 aa, Artificial Sequence
  Synthesized
RSDDLQR

SEQ ID NO: 293 - DNA, 24 bp, Homo sapiens
accatcaacagactggaagtgggg

SEQ ID NO: 294 - protein, 7 aa, Artificial Sequence
  Synthesized
QTVNLDR

SEQ ID NO: 295 - protein, 7 aa, Artificial Sequence
  Synthesized
KKDHLHR

SEQ ID NO: 296 - DNA, 24 bp, Homo sapiens
agctgccccttcgcggacgtggcc

SEQ ID NO: 297 - protein, 7 aa, Artificial Sequence
  Synthesized
HHNSLTR

SEQ ID NO: 298 - protein, 7 aa, Artificial Sequence
  Synthesized
MKHHLDA

SEQ ID NO: 299 - protein, 7 aa, Artificial Sequence
  Synthesized
DPSNLRR

SEQ ID NO: 300 - protein, 7 aa, Artificial Sequence
  Synthesized
RREVLEN

SEQ ID NO: 301 - protein, 7 aa, Artificial Sequence
  Synthesized
QSGSLTR

SEQ ID NO: 302 - protein, 7 aa, Artificial Sequence
  Synthesized
DRSDLTR

SEQ ID NO: 303 - protein, 7 aa, Artificial Sequence
  Synthesized
QSSALTR

SEQ ID NO: 304 - DNA, 24 bp, Homo sapiens
tgcggcaacctacatgatggggaa

SEQ ID NO: 305 - protein, 7 aa, Artificial Sequence
  Synthesized
QRSNLVR

SEQ ID NO: 306 - protein, 7 aa, Artificial Sequence
  Synthesized
RSDHLTR

SEQ ID NO: 307 - protein, 7 aa, Artificial Sequence
  Synthesized
TSANLSR

SEQ ID NO: 308 - protein, 7 aa, Artificial Sequence
  Synthesized
QSSDLTR

SEQ ID NO: 309 - protein, 7 aa, Artificial Sequence
  Synthesized
RSDNLAR

SEQ ID NO: 310 - protein, 7 aa, Artificial Sequence
  Synthesized
QSGHLQR

SEQ ID NO: 311 - DNA, 23 bp, Homo sapiens
agcctctccagccaggggctgag

SEQ ID NO: 312 - protein, 7 aa, Artificial Sequence
  Synthesized
RSDHLSR

SEQ ID NO: 313 - protein, 7 aa, Artificial Sequence
  Synthesized
RSDHLAR

SEQ ID NO: 314 - protein, 7 aa, Artificial Sequence
  Synthesized
QSGDLTR

SEQ ID NO: 315 - protein, 7 aa, Artificial Sequence
  Synthesized
RSDDLTR

SEQ ID NO: 316 - protein, 7 aa, Artificial Sequence
  Synthesized
RSDALTR

SEQ ID NO: 317 - protein, 7 aa, Artificial Sequence
  Synthesized
TSGHLVR

SEQ ID NO: 318 - protein, 7 aa, Artificial Sequence
  Synthesized
QSSDLQR

SEQ ID NO: 319 - DNA, 24 bp, Artificial Sequence
  Synthesized
ccctgccgcctgcctgctggtgtg

SEQ ID NO: 320 - protein, 7 aa, Artificial Sequence
  Synthesized
GGTALRM

SEQ ID NO: 321 - protein, 7 aa, Artificial Sequence
  Synthesized
QRSSLVR

SEQ ID NO: 322 - protein, 7 aa, Artificial Sequence
  Synthesized
QRNNLGR

SEQ ID NO: 323 - protein, 7 aa, Artificial Sequence
  Synthesized
RKRNLIM

SEQ ID NO: 324 - protein, 7 aa, Artificial Sequence
  Synthesized
VRHNLTR

SEQ ID NO: 325 - protein, 7 aa, Artificial Sequence
  Synthesized
RGDKLGP

SEQ ID NO: 326 - DNA, 24 bp, Homo sapiens
gtttacttcctttggggggattgc

SEQ ID NO: 327 - protein, 7 aa, Artificial Sequence
  Synthesized
SRFTLGR

SEQ ID NO: 328 - protein, 7 aa, Artificial Sequence
  Synthesized
RREHLVR

SEQ ID NO: 329 - protein, 7 aa, Artificial Sequence
  Synthesized
QTATLKR

SEQ ID NO: 330 - protein, 7 aa, Artificial sequence
  Synthesized
KHSNLAR

SEQ ID NO: 331 - protein, 7 aa, Artificial Sequence
  Synthesized
QSTTLKR

SEQ ID NO: 332 - protein, 7 aa, Artificial Sequence
  Synthesized
RADGLQL

SEQ ID NO: 333 - DNA, 24 bp, Artificial Sequence
  Synthesized
cacccctgcaccgactcggcagag

SEQ ID NO: 334 - protein, 7 aa, Artificial Sequence
  Synthesized
TRQKLET

SEQ ID NO: 335 - protein, 7 aa, Artificial Sequence
  Synthesized
RQDNLGR

SEQ ID NO: 336 - protein, 7 aa, Artificial Sequence
  Synthesized
QQHGLRH

SEQ ID NO: 337 - protein, 7 aa, Artificial Sequence
  Synthesized
TKKILTV

SEQ ID NO: 338 - protein, 7 aa, Artificial Sequence
  Synthesized
HKSSLTR

SEQ ID NO: 339 - protein, 7 aa, Artificial Sequence
  Synthesized
RSDHLSL

SEQ ID NO: 340 - DNA, 23 bp, Homo sapiens
accctcacaacctttgggttgtc

SEQ ID NO: 341 - protein, 7 aa, Artificial Sequence
  Synthesized
RKHHLGR

SEQ ID NO: 342 - protein, 7 aa, Artificial Sequence
  Synthesized
VSNSLAR

SEQ ID NO: 343 - protein, 7 aa, Artificial Sequence
  Synthesized
RTSSLKR

SEQ ID NO: 344 - protein, 7 aa, Artificial Sequence
  Synthesized
QRSDLTR

SEQ ID NO: 345 - protein, 7 aa, Artificial Sequence
  Synthesized
RSDGLRG

SEQ ID NO: 346 - DNA, 24 bp, Homo sapiens
ccccccagcaccctttcggctgtg

SEQ ID NO: 347 - protein, 7 aa, Artificial Sequence
  Synthesized
DSPTLRR

SEQ ID NO: 348 - protein, 7 aa, Artificial Sequence
  Synthesized
QSAHLKR

SEQ ID NO: 349 - protein, 7 aa, Artificial Sequence
  Synthesized
QDVSLVR

SEQ ID NO: 350 - protein, 7 aa, Artificial Sequence
  Synthesized
MKNTLTR

SEQ ID NO: 351 - protein, 7 aa, Artificial Sequence
  Synthesized
QSGTLTR

SEQ ID NO: 352 - DNA, 24 bp, Homo sapiens
ggctcctgctgcatcgtagctgct

SEQ ID NO: 353 - protein, 7 aa, Artificial Sequence
  Synthesized
TKQILGR

SEQ ID NO: 354 - protein, 7 aa, Artificial Sequence
  synthesized
RTEHLAR

SEQ ID NO: 355 - protein, 7 aa, Artificial Sequence
  Synthesized
KRRDLDR

SEQ ID NO: 356 - protein, 237 aa, Artificial Sequence
  Synthesized
DIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKGGGGSGGGGSGGGGSEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSS

SEQ ID NO: 357 - protein, 7 aa, Artificial Sequence
  Synthesized
RTSSLKR

SEQ ID NO: 358 - protein, 7 aa, Artificial Sequence
  Synthesized
QRSDLTR

SEQ ID NO: 359 - protein, 7 aa, Artificial Sequence
  Synthesized
RSDHLSL

SEQ ID NO: 360 - DNA, 25 bp, Homo sapiens
cacagcccaagatagttaagtgggg

SEQ ID NO: 361 - protein, 7 aa, Artificial Sequence
  Synthesized
KKDHLHR

SEQ ID NO: 362 - protein, 7 aa, Artificial Sequence
  Synthesized
RREVLEN

SEQ ID NO: 363 - protein, 7 aa, Artificial Sequence
  Synthesized
QRGNLNM

SEQ ID NO: 364 - protein, 7 aa, Artificial Sequence
  Synthesized
VPSKLKR

SEQ ID NO: 365 - protein, 7 aa, Artificial Sequence
  Synthesized
EAHHLSR

SEQ ID NO: 366 - protein, 7 aa, Artificial Sequence
  Synthesized
QDGNLTR

SEQ ID NO: 367 - protein, 7 aa, Artificial Sequence
  Synthesized
TSTLLNR

SEQ ID NO: 368 - protein, 7 aa, Artificial Sequence
  Synthesized
QQTNLTR

SEQ ID NO: 369 - protein, 7 aa, Artificial Sequence
  Synthesized
VGNSLTR

SEQ ID NO: 370 - protein, 7 aa, Artificial Sequence
  Synthesized
QSGSLTR

SEQ ID NO: 371 - protein, 7 aa, Artificial Sequence
  Synthesized
TSGNLVR

SEQ ID NO: 372 - protein, 7 aa, Artificial Sequence
  Synthesized
QSGDLTR

SEQ ID NO: 373 - protein, 7 aa, Artificial Sequence
  Synthesized
RSDNLAR

SEQ ID NO: 374 - protein, 7 aa, Artificial Sequence
  Synthesized
DRSDLTR

SEQ ID NO: 375 - protein, 7 aa, Artificial Sequence
  Synthesized
QSGHLQR

SEQ ID NO: 376 - protein, 7 aa, Artificial Sequence
  Synthesized
DRSHLTR

SEQ ID NO: 377 - protein, 7 aa, Artificial Sequence
  Synthesized
RSDALSR

SEQ ID NO: 378 - protein, 7 aa, Artificial Sequence
  Synthesized
QSSDLQR

SEQ ID NO: 379 - protein, 7 aa, Artificial Sequence
  Synthesized
ERGTLAR

SEQ ID NO: 380 - protein, 7 aa, Artificial Sequence
  Synthesized
RSDDLQR

SEQ ID NO: 381 - protein, 7 aa, Artificial Sequence
  Synthesized
RSDALTR

SEQ ID NO: 382 - protein, 7 aa, Artificial Sequence
  Synthesized
RSDHLAR

SEQ ID NO: 383 - protein, 7 aa, Artificial Sequence
  Synthesized
QSGDLTR

SEQ ID NO: 384 - protein, 7 aa, Artificial Sequence
  Synthesized
QSGHLQR

SEQ ID NO: 385 - protein, 7 aa, Artificial Sequence
  Synthesized
QSSDLTR

SEQ ID NO: 386 - protein, 7 aa, Artificial Sequence
  Synthesized
RSDNLRE

SEQ ID NO: 387 - protein, 7 aa, Artificial Sequence
  Synthesized
RSDHLSR

SEQ ID NO: 388 - protein, 7 aa, Artificial Sequence
  Synthesized
QSGHLAR

SEQ ID NO: 389 - protein, 7 aa, Artificial Sequence
  Synthesized
DRSDLTR

SEQ ID NO: 390 - protein, 7 aa, Artificial Sequence
  Synthesized
QSGNLAR

SEQ ID NO: 391 - protein, 7 aa, Artificial Sequence
  Synthesized
DRSHLTR

SEQ ID NO: 392 - protein, 7 aa, Artificial Sequence
  Synthesized
QSGDLTR

SEQ ID NO: 393 - protein, 7 aa, Artificial Sequence
  Synthesized
QSGHLQR

SEQ ID NO: 394 - protein, 7 aa, Artificial Sequence
  Synthesized
RSHILTN

SEQ ID NO: 395 - protein, 7 aa, Artificial Sequence
  Synthesized
QSTTLKR

SEQ ID NO: 396 - protein, 7 aa, Artificial Sequence
  Synthesized
DGGHLTR

SEQ ID NO: 397 - protein, 7 aa, Artificial Sequence
  Synthesized
RQMNLDR

SEQ ID NO: 398 - protein, 7 aa, Artificial Sequence
  Synthesized
RQDNLGR

SEQ ID NO: 399 - protein, 7 aa, Artificial Sequence
  Synthesized
DKSVLAR

SEQ ID NO: 400 - DNA, 23 bp, Homo sapiens
gccaccttcccccagctgaagtc

SEQ ID NO: 401 - DNA, 24 bp, Homo sapiens
tgcatctgcgacgtgggagccgag

SEQ ID NO: 402 - DNA, 23 bp, Homo sapiens
gcccacagccactcgtggcggcc

SEQ ID NO: 403 - DNA, 23 bp, Homo sapiens
ccctgctccctccgggggctgct

SEQ ID NO: 404 - DNA, 23 bp, Homo sapiens
tccggcttctccatggagcaggc

SEQ ID NO: 405 - DNA, 24 bp, Homo sapiens
cactgcgcccacgaggccgaggag

SEQ ID NO: 406 - protein, 7 aa, Artificial Sequence
  Synthesized
HKWVLRQ

SEQ ID NO: 407 - protein, 7 aa, Artificial Sequence
  Synthesized
DRSNLTR

SEQ ID NO: 408 - DNA, 19 bp, Homo sapiens
gttgctccaggccacagca

SEQ ID NO: 409 - protein, 7 aa, Artificial Sequence
  Synthesized
QSGDLTR

SEQ ID NO: 410 - protein, 7 aa, Artificial Sequence
  Synthesized
QWGTRYR

SEQ ID NO: 411 - protein, 7 aa, Artificial Sequence
  Synthesized
ERGTLAR

SEQ ID NO: 412 - protein, 7 aa, Artificial Sequence
  Synthesized
QSGDLTR

SEQ ID NO: 413 - protein, 7 aa, Artificial Sequence
  Synthesized
TSGALTR

SEQ ID NO: 414 - DNA, 12 bp, Homo sapiens
gactttgcatgt

SEQ ID NO: 415 - protein, 7 aa, Artificial Sequence
  Synthesized
WRSSLAS

SEQ ID NO: 416 - protein, 7 aa, Artificial Sequence
  Synthesized
QSGSLTR

SEQ ID NO: 417 - protein, 9 aa, Artificial Sequence
  Synthesized
TGPGAAARA

SEQ ID NO: 418 - protein, 5 aa, Artificial Sequence
  Synthesized
LRGSQ

SEQ ID NO: 419 - DNA, 18 bp, Homo sapiens
ctccagccaggtccatct

SEQ ID NO: 420 - DNA, 17 bp, Homo sapiens
tctccagccaggtccat

SEQ ID NO: 421 - DNA, 15 bp, Homo sapiens
tcagcaggctgttgt

SEQ ID NO: 422 - DNA, 17 bp, Homo sapiens
tcagcaggctgttgtgt

SEQ ID NO: 423 - DNA, 15 bp, Homo sapiens
ccctggtctcttcat

SEQ ID NO: 424 - DNA, 16 bp, Homo sapiens
aagcctccctggtctt

SEQ ID NO: 425 - DNA, 15 bp, Homo sapiens
aagcctccctggtct

SEQ ID NO: 426 - DNA, 17 bp, Homo sapiens
gctgaccccctgtgcct

SEQ ID NO: 427 - DNA, 16 bp, Homo sapiens
gaccccctgtgcctct

SEQ ID NO: 428 - protein, 21 aa, Artificial Sequence
  Synthesized
MALPVTALLLPLALLLHAARP

SEQ ID NO: 429 - protein, 111 aa, Artificial Sequence
  Synthesized
QSVLTQPPSVSAAPGQKVTISCSGSSSDIGSNYVSWYQQFPGTAPKLLIYDNNKRPSAIPDRFSGSKSGTSATLGITGLQTGDEADYYCGTWDSRLGIAVFGGGTQLTVLG

SEQ ID NO: 430 - protein, 119 aa, Artificial Sequence [sequence omitted]

SEQ ID NO: 431 - protein, 20 aa, Artificial Sequence
  Synthesized
GGGGSGGGGSGGGGSGGGGS

SEQ ID NO: 432 - protein, 120 aa, Artificial Sequence
  Synthesized
EVQLVESGGGLVQPGGSLRLSCAASGVSLPDYGVSWVRQAPGKGLEWVSVIWGSETTYYNSALKSRFTISRDNAKNSLYLQMNSLRAEDTAVYYCAKHYYYGGSYAMDYWGQGTLVTVSS

SEQ ID NO: 433 - protein, 107 aa, Artificial Sequence; identical to SEQ ID NO: 74
  Synthesized

SEQ ID NO: 434 - protein, 240 aa, Artificial Sequence
  Synthesized
DIVMTQSHKFMSTSIGARVSITCKASQDVRTAVAWYQQKPGQSPKLLIYSASYRYTGVPDRFTGSGSGTDFTFTISSVQAEDLAVYYCQQHYGTPPWTFGGGTKLEIKGGGGSGGGGSGGGGSEVQLVESGGGLVKPGGSLKLSCEASRFTFSSYAMSWVRQTPEKRLEWVAAISGGGRYTYYPDSMKGRFTISRDNAKNFLYLQMSSLRSEDTAMYYCARHYDGYLDYWGQGTTLTVSS

SEQ ID NO: 435 - protein, 238 aa, Artificial Sequence
  Synthesized
DIVMTQSHKFMSTSIGARVSITCKASQDVRTAVAWYQQKPGQSPKWYSASYRYTGVPDRFTGSGSGTDFTFTISSVQAEDLAVYYCQQHYGTPPWTFGGGTKLEIKGGGGSGGGGSGGGGSEVQLVESGGGLVKPGGSLKLSCEASRFTFSSYAMSWVRQTPEKRLEWVAAISGGGRYTYYPDSMKGRFTISRDNAKNFLYLQMSSLRSEDTAMYYCARHYDGYLDYWGQGTTLTVSS

SEQ ID NO: 436 - protein, 244 aa, Artificial Sequence
  Synthesized
EVQLVESGGGLVQPGGSLRLSCAASGFTFSSFGMHWVRQAPGKGLEWVAYISSDSSAIYYADTVKGRFTISRDNAKNSLYLQMNSLRDEDTAVYYCGRGRENIYYGSRLDYWGQGTTVTVSSGGGGSGGGGSGGGGSDIQLTQSPSFLSASVGDRVTITCKASQNVDTNVAWYQQKPGKAPKALIYSASYRYSGVPSRFSGSGSGTDFTLTISSLQPEDFATYYCQQYNNYPFTFGQGTKLEIK

SEQ ID NO: 437 - protein, 113 aa, Artificial Sequence
  Synthesized
DIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIK

SEQ ID NO: 438 - protein, 118 aa, Artificial Sequence
  Synthesized
QVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSS

SEQ ID NO: 439 - protein, 490 aa, Artificial Sequence
  Synthesized
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 440 - protein, 510 aa, Artificial Sequence
  synthesized
DIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSGGGGSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSS

SEQ ID NO: 441 - protein, 510 aa, Artificial Sequence
  synthesized
DIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSGGGGSGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELK

SEQ ID NO: 442 - protein, 510 aa, Artificial Sequence
  synthesized
DIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSGGGGSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSS

SEQ ID NO: 443 - protein, 510 aa, Artificial Sequence
  synthesized
DIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSGGGGSGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELK

SEQ ID NO: 444 - protein, 510 aa, Artificial Sequence
  synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSS

SEQ ID NO: 445 - protein, 510 aa, Artificial Sequence
  synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIK

SEQ ID NO: 446 - protein, 510 aa, Artificial Sequence
  synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSS

SEQ ID NO: 447 - protein, 510 aa, Artificial Sequence
  synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELK

SEQ ID NO: 448 - protein, 754 aa, Artificial Sequence
  synthesized
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSGGGGSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 449 - protein, 754 aa, Artificial Sequence
  synthesized
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSGGGGSGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 450 - protein, 754 aa, Artificial Sequence
  synthesized
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSGGGGSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 451 - protein, 754 aa, Artificial Sequence
  synthesized
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSGGGGSGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 452 - protein, 754 aa, Artificial Sequence
  synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 453 - protein, 754 aa, Artificial Sequence
  synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 454 - protein, 754 aa, Artificial Sequence
  synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 455 - protein, 754 aa, Artificial Sequence
  synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 456 - protein, 753 aa, Artificial Sequence
  synthesized
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSGGGGSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 457 - protein, 753 aa, Artificial Sequence
  synthesized
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSGGGGSGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 458 - protein, 753 aa, Artificial Sequence
  synthesized
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSGGGGSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 459 - protein, 753 aa, Artificial Sequence
  synthesized
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSGGGGSGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 460 - protein, 753 aa, Artificial Sequence
  synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 461 - protein, 753 aa, Artificial Sequence
  synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 462 - protein, 753 aa, Artificial Sequence
  synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 463 - protein, 753 aa, Artificial Sequence
  synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 464 - protein, 242 aa, Artificial Sequence; identical to SEQ ID NO: 5
  synthesized

SEQ ID NO: 465 - protein, 242 aa, Artificial Sequence
  synthesized
EVQLVESGGGLVQPGGSLRLSCAASGVSLPDYGVSWVRQAPGKGLEWVSVIWGSETTYYNSALKSRFTISRDNAKNSLYLQMNSLRAEDTAVYYCAKHYYYGGSYAMDYWGQGTLVTVSSGGGGSGGGGSGGGGSDIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGQGTKVEIK

SEQ ID NO: 466 - protein, 245 aa, Artificial Sequence
  synthesized
QSVLTQPPSVSAAPGQKVTISCSGSSSDIGSNYVSWYQQFPGTAPKLLIYDNNKRPSAIPDRFSGSKSGTSATLGITGLQTGDEADYYCGTWDSRLGIAVFGGGTQLTVLGGGGGSGGGGSGGGGSEVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSS

SEQ ID NO: 467 - protein, 245 aa, Artificial Sequence
  synthesized
EVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSGGGGGSGGGGSGGGGSQSVLTQPPSVSAAPGQKVTISCSGSSSDIGSNYVSWYQQFPGTAPKLLIYDNNKRPSAIPDRFSGSKSGTSATLGITGLQTGDEADYYCGTWDSRLGIAVFGGGTQLTVL

SEQ ID NO: 468 - protein, 241 aa, Artificial Sequence; identical to SEQ ID NO: 11
  synthesized

SEQ ID NO: 469 - protein, 241 aa, Artificial Sequence
  synthesized
QVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSGGGGSGGGGSGGGGSEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIK

SEQ ID NO: 470 - protein, 243 aa, Artificial Sequence
  synthesized
QSVLTQPASVSGSPGQSVTISCTGTSSDVGGYNYVSWYQQHPGKPPKLMIYEVSKRPSGVPDRFSGSKSGNTASLTISGLQAEDEADYYCSSHTSSNTLIFGGGTKVTVLGGGGSGGGGSGGGGSEVQLVQSGAEVKKPGESLKISCKGSGYTFTNYWIGWVRQMPGKGLEWMGRIYPSDSYTNYSPSFQGQVTISADKSISTAYLQWSSLKASDTAMYYCARDLEPTHHYSWGQGTLVTVSS

SEQ ID NO: 471 - protein, 243 aa, Artificial Sequence
  synthesized
EVQLVQSGAEVKKPGESLKISCKGSGYTFTNYWIGWVRQMPGKGLEWMGRIYPSDSYTNYSPSFQGQVTISADKSISTAYLQWSSLKASDTAMYYCARDLEPTHHYSWGQGTLVTVSSGGGGSGGGGSGGGGSQSVLTQPASVSGSPGQSVTISCTGTSSDVGGYNYVSWYQQHPGKPPKLMIYEVSKRPSGVPDRFSGSKSGNTASLTISGLQAEDEADYYCSSHTSSNTLIFGGGTKVTVL

SEQ ID NO: 472 - protein, 236 aa, Artificial Sequence
  synthesized
SIVMTQSPATLSVTPGDRVSLSCRASQSIGDYLHWFQQKSHESPRLLIKYASQSISGIPSRFSGSGSGSDFTLIINTMEPEDVGVYYCQNAHTYPYTFGGGTKLEIKGGGGSGGGGSGGGGSQVKLQQSGPELVRPGASVKMSCKASGYTFTTYWMHWVKQRPGQGLEWIGMIDPSNSDTRLNQKFKDKATLNVDTSSNTAYMHLSSLTSEDSAVYYCTLGGTEYWGQGATLTVSS

SEQ ID NO: 473 - protein, 236 aa, Artificial Sequence
  synthesized
QVKLQQSGPELVRPGASVKMSCKASGYTFTTYWMHWVKQRPGQGLEWIGMIDPSNSDTRLNQKFKDKATLNVDTSSNTAYMHLSSLTSEDSAVYYCTLGGTEYWGQGATLTVSSGGGGSGGGGSGGGGSSIVMTQSPATLSVTPGDRVSLSCRASQSIGDYLHWFQQKSHESPRLLIKYASQSISGIPSRFSGSGSGSDFTLIINTMEPEDVGVYYCQNAHTYPYTFGGGTKLEIK

SEQ ID NO: 474 - protein, 242 aa, Artificial Sequence
  synthesized
SIVMTQTPLTLSVTIGQPASISCKSSQSLLYSDGQTYLNWLLQRPGQSPKRLIYLVSKLDSGVPDRFTGSGSGTDFTLKISRVEAEDLGVYYCVQTTHFPYTFGGGTKLEMKGGGGSGGGGSGGGGSQVQLKESGGGLVQPGESLKLSCESSEFPFPSHDMSWVRKTPEKRLELVAAINSDGGSTYYPDTMERRFIISRDNTKKTLYLQMSSLRSEDTALYYCASLPTFAYWGQGTLVTVSA

SEQ ID NO: 475 - protein, 242 aa, Artificial Sequence
  synthesized
QVQLKESGGGLVQPGESLKLSCESSEFPFPSHDMSWVRKTPEKRLELVAAINSDGGSTYYPDTMERRFIISRDNTKKTLYLQMSSLRSEDTALYYCASLPTFAYWGQGTLVTVSAGGGGSGGGGSGGGGSSIVMTQTPLTLSVTIGQPASISCKSSQSLLYSDGQTYLNWLLQRPGQSPKRLIYLVSKLDSGVPDRFTGSGSGTDFTLKISRVEAEDLGVYYCVQTTHFPYTFGGGTKLEMK

SEQ ID NO: 476 - protein, 237 aa, Artificial Sequence
  synthesized
DIVMTQSHKFMSTSVGDRVSIICKASQDVGTAVDWYQQKPGQSPKLLIYWASTRHTGVPDRFTGSGSGTDFTLAITNVQSEDLADYFCQQYNSYPLTFGAGTKLEIKGGGGSGGGGSGGGGSEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTLTVSS

SEQ ID NO: 477 - protein, 237 aa, Artificial Sequence
  synthesized
EVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTLTVSSGGGGSGGGGSGGGGSDIVMTQSHKFMSTSVGDRVSIICKASQDVGTAVDWYQQKPGQSPKLLIYWASTRHTGVPDRFTGSGSGTDFTLAITNVQSEDLADYFCQQYNSYPLTFGAGTKLEIK

SEQ ID NO: 478 - protein, 245 aa, Artificial Sequence
  Synthesized
DIQMTRAPDSLSASVGDRVTITCRASQGVDIYVAWYQQKPGKAPKLLMHSASTLASGVPSRFSGRGSGTDFTLTINSLQAEDVATYYCQSHNSAVVTFGQGTRLEIKGGGGSGGGGSGGGGSEVQLLESGGGLVQPGGSLRLSCAASGFTFSRYVMVWVRQAPGKGLDWVSGISPSGGVTRYADSVKGRFTISRDNSKNTLYLQMNSLRAEDTAMYYCARIRKEMTTISYFFDYWGQGTLVTVSS

SEQ ID NO: 479 - protein, 246 aa, Artificial Sequence
  Synthesized
QIVLTQSPAIMSASLGERVTMTCTASSSVNSFYLHWYQQKPGSSPKLWIHSTSNLASGVPGRFSGSGSGTSYSLTISSMEAEDAATYYCHQYHRSPYTFGGGTKLEIKGGGGSGGGGSGGGGSQVQLQQSGAELMKPGASVKISCKATGYTFSSYWIEWVKQRPGHGLEWIGEILPGSGNTYYNERFKDKATFTADTSSNTAYMQLSSLTSEDSAVYYCARRAAAYYSNPEWFAYWGQGTLVTVSA

SEQ ID NO: 480 - DNA, 9780 bp, Artificial Sequence
  Synthesized
cggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggatccgccaccatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtcgactctagaactagtaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgccgcggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagccatattcaacgggaaacgtcttgctctaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctggctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgatcacgagactagcctcgacacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttatcgacttaacttgtttattgcagcttataatggttacaaataaggcaatagcatcacaaatttcacaaataaggcatttttttcactgcattctagttttggtttgtccaaactcatcaatgtatcttatcatgtctggatctcaaatccctcggaagctgcgcctgtcttaggttggagtgatacatttttatcacttttacccgtctttggattaggcagtagctctgacggccctcctgtcttaggttagtgaaaaatgtcactctcttacccgtcattggctgtccagcttagctcgcaggggaggtggtcttcattactggctagctcttctgcctctaaacagcatctggctcctcttcctcttgccggttttagcagcggggctcagttcggccatcacttggatcagctcgtggatggcctttctctggacgttcagatcggtcacggagtagttggtgagcttctcgaagtcgtccctcttcttcttgttgctgttgaagaatttcacgttcatatcctccttgatggtctcgacgctcttctggatgctctggtcgtccttgaagttcttgaagagcttgaagtagaagctcacgatctgggactgcatgatctttctatcggactcctccttccagttcttcagaatgccgagaaacagtgtgccgttatcggccacgtcggagtggccggcattgaagtacttcttgaggttctcggcctccttcacgtaggggtcttggcagtagcagcccagagagcccagcacgatgcacagctggaaggccagaatgtagctggtgtacttcatggggccggggttctcctcgacatctccggcttgcttcagcagagagaaattggtggcgccgctgcccatttgccgaagagccctcaggctggactgcaggaactccttaaagctgcgcagaatgagatgagttgtcatgtcctgcagccactggttctgtgcctgcagcttcgtcagcaggctggcatttgtggttgggtcaggggtggttattgcatctagattctttgcctttttctgcaggaactggatcaggacttttgtactcatctgcacagctctggcttgttcctcactactctcaaatctgttctggaggtactctaggtatacctcaaactccaaaagaccagtgatgattttcaccaggcaagtctcctcattgaatccagattggaagcatccatctttttcagccatctttggaaggttcaggttgttttctgccagtgcctctttgctgctttcacacatgttactcttgttacatgtctcctttctcagggctgagatgccgtcgaggatgtaccgaatttgtttgtcaattcgttctgaagaggtgagtggctgtctgtgtggggcggctacatctttggaatcttctcctgggggtactggggcagggaaggcagcaggcaacaccaggagcagccccagggagaaggcaactggaccgaaggcgcttgtggagaaggagttcatggtggccaggagttgaggttactgtgagtagtgattaaagagagtgatagggaactcttgaacaagagatgcaatttatactgttaattctggaaaaatattatgggggtgtcaaaatgtcccgggaccaattgacgccttctgtatgaaacagtttttcctcctaattgacgccttctgtatgaaacagtttttcctcctaattgacgccttctgtatgaaacagtttttcctcctaattcgatgggaccaattgacgccttctgtatgaaacagtttttcctcctaattgacgccttctgtatgaaacagtttttcctcctaattgacgccttctgtatgaaacagtttttcctcctaattcgatatcaagcttatcgataccgtcgacctcgatgaattcgctagcaaatccactttggctcga

SEQ ID NO: 481 - DNA, 390 bp, Artificial Sequence
  Synthesized
tcgaggtcgacggtatcgataagcttgatatcgaattaggaggaaaaactgtttcatacagaaggcgtcaattaggaggaaaaactgtttcatacagaaggcgtcaattaggaggaaaaactgtttcatacagaaggcgtcaattggtcccatcgaattaggaggaaaaactgtttcatacagaaggcgtcaattaggaggaaaaactgtttcatacagaaggcgtcaattaggaggaaaaactgtttcatacagaaggcgtcaattggtcccgggacattttgacacccccataatatttttccagaattaacagtataaattgcatctcttgttcaagagttccctatcactctctttaatcactactcacagtaacctcaactcctg

SEQ ID NO: 482 - protein, 212 aa, Homo sapiens
MNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 483 - DNA, 57 bp, Homo sapiens
gccacgaacttctctctgttaaagcaagcaggagacgtggaagaaaaccccggtcct

SEQ ID NO: 484 - protein, 326 aa, Homo sapiens
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 485 - DNA, 10436 bp, Artificial Sequence
  Synthesized
cggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggatccgccaccatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtcgactctagaactagtaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgccgcggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagccatattcaacgggaaacgtcttgctctaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctggctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgatcacgagactagcctcgacacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttatcgacttaacttgtttattgcagcttataatggttacaaataaggcaatagcatcacaaatttcacaaataaggcatttttttcactgcattctagttttggtttgtccaaactcatcaatgtatcttatcatgtctggatctcaaatccctcggaagctgcgcctgtcttaggttggagtgatacatttttatcacttttacccgtctttggattaggcagtagctctgacggccctcctgtcttaggttagtgaaaaatgtcactctcttacccgtcattggctgtccagcttagctcgcaggggaggtggtctcagtcgttggagccgaagtccagagagatgatggtgtctccagcggcgggggccagcagtgtcagagcatcgggctccttcttcagcttgtcaaacagagagctggtgtcctcgctctccaccttggtgaagagctgggtcatcttcatgtcgctgctctccacgggcttcagcacgcactcggtctgctgcagagagaagatcagatcgtgctggatgattcctctggcagcggcctctctagcagcggcttcgctggcgttcaggtagctcatcacccggtcgatggtcacggcccggatccggaaggcatgcaggaggatgcacagcttgatcttggtcttgtagaagtcgggctcttccaggctggacttctggggcactgtctcgctgttgaagttcagggcctgcatcagctcgtcgatcacggccagcatgttctgatccaggaagatctgccgcttggggtccatcagcagcttggcgttcatggtcttgaactccacctggtacatcttcaggtcctcgtagatgctgctcaggcacagggccatcatgaagctggtctttctgctggccaggcaagagccgttggtgatgaagcttgtctcccgagagttcagacagctctcgttcttggtcagttccaggggcaggcaggcctccacggtgctggtcttatccttggtgatgtcctcgtggtcgatttcctcgctggtgcaggggtagaattccagggtctgccgggccttctgcagcatgttgctcacggcccgcagcaggttctggctgtggtgcaggcaggggaacatgccggggtcgggggtagccacgggcaggttccggcttcctccgccccctccgccgctgcagggcacgctggcccactcggaccaggagctgctgtagtaccggtcctgggcccgcacgctgatgctggcgttcttccggcagatcacggtggcgctggtcttgtcggtgaacacccggtctttcttctcccgcttgctcttgccctgcacctgcacacagaaggtcaggctgaagtagctgtggggggtggaccaggtgtcagggtactcccaggacacctccacctgccggctgttcttcaggggcttcagctgcaggttcttgggggggtcgggcttgatgatgtcccggatgaaaaagctggaggtgtagttctcgtacttcagcttgtgcacggcgtccaccatcacctcgatgggcaggctttcctcggcggcagggcaggcgctatcttcctggcactcgacgctgtactcgtactctttgttgtcgccccgcactctctcggcgctcagggtggcggctccgcaggtcacgccctgagggtcgctgctgccccggctgctcttcacgctgaaggtcaggtcggtgctgatggtggtcagccaccaacaggtgaaccggccgctgtagttcttggcctcgcaccgcaggaaggtcttgttcttgggctctttctggtccttcaggatgtcggtggaccagatgccatcctctttcttgtgcagcagcagcaggctgtgggacagcacttcgccgcccttgtggcaggtgtactggccggcgtcgccgaactctttgacctggatggtcagggtcttgccgctgcccagcacctcgctgctctggtccagggtccaggtgatgccgtcctcttcgggggtgtcgcaggtcagcaccaccatctcgccaggggcgtcgggataccagtccagctccaccacgtacacgtctttcttcagctcccagatggccaccagggggctggccaggaacaccaggctgaaccagctgatgaccagctgctgatgacacatggtggccaggagttgaggttactgtgagtagtgattaaagagagtgatagggaactcttgaacaagagatgcaatttatactgttaattctggaaaaatattatgggggtgtcaaaatgtcccgggaccaattgacgccttctgtatgaaacagtttttcctcctaattgacgccttctgtatgaaacagtttttcctcctaattgacgccttctgtatgaaacagtttttcctcctaattcgatgggaccaattgacgccttctgtatgaaacagtttttcctcctaattgacgccttctgtatgaaacagtttttcctcctaattgacgccttctgtatgaaacagtttttcctcctaattcgatatcaagcttatcgataccgtcgacctcgatgaattcgctagcaaatccactttggctcgagaagcttgatat

SEQ ID NO: 486 - protein, 219 aa, Homo sapiens
MCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 487 - protein, 74 aa, Artificial Sequence
  Synthesized
GIIQHDLIFSLQQTECVLKPVESSDMKMTQLFTKVESEDTSSLFDKLKKEPDALTLLAPAAGDTIISLDFGSND

SEQ ID NO: 488 - protein, 485 aa, Artificial Sequence
  Synthesized
MALPVTALLLPLALLLHAARPEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKGGGGSGGGGSGGGGSQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSAKPTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 489 - protein, 264 aa, Artificial Sequence
  Synthesized
MALPVTALLLPLALLLHAARPQSVLTQPASVSGSPGQSVTISCTGTSSDVGGYNYVSWYQQHPGKPPKLMIYEVSKRPSGVPDRFSGSKSGNTASLTISGLQAEDEADYYCSSHTSSNTLIFGGGTKVTVLGGGGSGGGGSGGGGSEVQLVQSGAEVKKPGESLKISCKGSGYTFTNYWIGWVRQMPGKGLEWMGRIYPSDSYTNYSPSFQGQVTISADKSISTAYLQWSSLKASDTAMYYCARDLEPTHHYSWGQGTLVTVSS

SEQ ID NO: 490 - protein, 267 aa, Artificial Sequence
  Synthesized
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSS

SEQ ID NO: 491 - protein, 264 aa, Artificial Sequence; identical to SEQ ID NO: 489
  Synthesized

SEQ ID NO: 492 - protein, 754 aa, Artificial Sequence; identical to SEQ ID NO: 454
  Synthesized

SEQ ID NO: 493 - protein, 753 aa, Artificial Sequence
  Synthesized
MALPVTALLLPLALLLHAARPQSVLTQPPSVSAAPGQKVTISCSGSSSDIGSNYVSWYQQFPGTAPKLLIYDNNKRPSAIPDRFSGSKSGTSATLGITGLQTGDEADYYCGTWDSRLGIAVFGGGTQLTVLGGGGGSGGGGSGGGGSEVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSGGGGSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 494 - protein, 753 aa, Artificial Sequence
  Synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSQSVLTQPPSVSAAPGQKVTISCSGSSSDIGSNYVSWYQQFPGTAPKLLIYDNNKRPSAIPDRFSGSKSGTSATLGITGLQTGDEADYYCGTWDSRLGIAVFGGGTQLTVLGGGGGSGGGGSGGGGSEVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 495 - protein, 750 aa, Artificial Sequence
  Synthesized
MALPVTALLLPLALLLHAARPQSVLTQPASVSGSPGQSVTISCTGTSSDVGGYNYVSWYQQHPGKPPKLMIYEVSKRPSGVPDRFSGSKSGNTASLTISGLQAEDEADYYCSSHTSSNTLIFGGGTKVTVLGGGGSGGGGSGGGGSEVQLVQSGAEVKKPGESLKISCKGSGYTFTNYWIGWVRQMPGKGLEWMGRIYPSDSYTNYSPSFQGQVTISADKSISTAYLQWSSLKASDTAMYYCARDLEPTHHYSWGQGTLVTVSSGGGGSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 496 - protein, 750 aa, Artificial Sequence
  Synthesized
MALPVTALLLPLALLLHAARPQSVLTQPASVSGSPGQSVTISCTGTSSDVGGYNYVSWYQQHPGKPPKLMIYEVSKRPSGVPDRFSGSKSGNTASLTISGLQAEDEADYYCSSHTSSNTLIFGGGTKVTVLGGGGSGGGGSGGGGSEVQLVQSGAEVKKPGESLKISCKGSGYTFTNYWIGWVRQMPGKGLEWMGRIYPSDSYTNYSPSFQGQVTISADKSISTAYLQWSSLKASDTAMYYCARDLEPTHHYSWGQGTLVTVSSGGGGSGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 497 - protein, 750 aa, Artificial Sequence
  Synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSQSVLTQPASVSGSPGQSVTISCTGTSSDVGGYNYVSWYQQHPGKPPKLMIYEVSKRPSGVPDRFSGSKSGNTASLTISGLQAEDEADYYCSSHTSSNTLIFGGGTKVTVLGGGGSGGGGSGGGGSEVQLVQSGAEVKKPGESLKISCKGSGYTFTNYWIGWVRQMPGKGLEWMGRIYPSDSYTNYSPSFQGQVTISADKSISTAYLQWSSLKASDTAMYYCARDLEPTHHYSWGQGTLVTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 498 - protein, 750 aa, Artificial Sequence
  Synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSEVQLVQSGAEVKKPGESLKISCKGSGYTFTNYWIGWVRQMPGKGLEWMGRIYPSDSYTNYSPSFQGQVTISADKSISTAYLQWSSLKASDTAMYYCARDLEPTHHYSWGQGTLVTVSSGGGGSGGGGSGGGGSQSVLTQPASVSGSPGQSVTISCTGTSSDVGGYNYVSWYQQHPGKPPKLMIYEVSKRPSGVPDRFSGSKSGNTASLTISGLQAEDEADYYCSSHTSSNTLIFGGGTKVTVLAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 499 - protein, 265 aa, Artificial Sequence
  Synthesized
MSPAQFLFLLVLWIQETNGDVVMTQTPLTLSVTIGQPASISCKSSQSLLYSNGKTYLNWLLQRPGQSPKRLIYLVSKLDSGVPDRFTGSGSGTDFTLKISRVEAEDLGVYYCVQGTHFPHTFGGGTKLEIKRMNFGLSLIFLVLVLKGVQCEVKVVESGGGLVKPGASLKLSCAASGFTFSNYGMSWVRQTSDKRLEWVASISSGGDSTFYADNVKGRFTISRENAKNTLYLQMSSLKSEDTALYYCARDDLFNWGQGTTLTVSS

SEQ ID NO: 500 - protein, 254 aa, Artificial Sequence
  Synthesized
VTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGILGSGGGGSGGGGSGGGGSQPVLTQSSSLSASPGASASLYHRCTLRSGINVGPYRIYWYQQSYSPGSPPQYLLNYKSDSDKQQGSGVPSRFSGSKDASANAGVLLISGLRSEDEADYYCMIWHSSAAVFGGGTQLTVLSAS

SEQ ID NO: 501 - protein, 262 aa, Artificial Sequence
  Synthesized
MVLLVTSLLLCELPHPAFLLIPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSS

SEQ ID NO: 502 - protein, 263 aa, Artificial Sequence
  Synthesized
MGWSCIILFLVATATGVHSDIQLTQSPSSLSASVGDRVTITCKASQDVGTSVAWYQQKPGKAPKLLIYWTSTRHTGVPSRFSGSGSGTDFTFTISSLQPEDIATYYCQQYSLYRSFGQGTKVEIKRGGSGSGGSGSGGSGSEVQLVESGGGVVQPGRSLRLSCSASGFDFTTYWMSWVRQAPGKGLEWIGEIHPDSSTINYAPSLKDRFTISRDNAKNTLFLQMDSLRPEDTGVYFCASLYFGFPWFAYWGQGTPVTVSSAKP

SEQ ID NO: 503 - protein, 311 aa, Artificial Sequence
  Synthesized
DVVMTQSPLSLPVTPGEPASISCRSSQSLVHSNANTYLHWYLQKPGQSPQLLIYKVSNRFSGVPDRFSGSGSGTDFTLKISRVGAGDVGVYYCSQNTHVPPTFGQGTKLEIKRGGGGSGGGGSGGGGSQVQLVQSGAEVKKPGASVKVSCKASGYTFTDYEMHWVRQAPGQGLEWMGALDPKTGDTAYSQKFKGRVTLTADESTSTAYMELSSLRSEDTAVYYCTRFYSYTYWGQGTLVTVSSTTTPAPRPPTPAPTIASQPLSLRPEACRPAAGGAVHTRGLDFALECDFWVLVVVGGVLACYSLLVTVA

SEQ ID NO: 504 - protein, 343 aa, Artificial Sequence
  Synthesized
GPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNESKYGPPCPPCPAPEFEGGPSVFLFPPKPKDTLMISRTPEVTCVVVAKDVSQEDPEVQFNWYVDVVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

The invention claimed is:

1. A method for preparing a mixed population of modified cells, the method comprising: transducing cells with (i) a first vector at a multiplicity of infection (MOI) of about 2 to about 15, the first vector comprising a polynucleotide encoding a first antigen binding molecule that binds a first antigen and (ii) a second vector at a MOI of about 30 to about 92, the second vector comprising a polynucleotide encoding a second antigen binding molecule that binds a second antigen to obtain a mixed population of modified cells comprising: (a) modified cells comprising the first antigen binding molecule and not the second antigen binding molecule; (b) modified cells comprising the second antigen binding molecule and not the first antigen binding molecule; and (c) modified cells comprising both the first and second antigen binding molecules, wherein the first antigen binding molecule binds a cell surface molecule of a B cell and the second antigen binding molecule binds a solid tumor antigen, and wherein the cells are T cells, natural killer (NK) cells, or dendritic cells.

2. The method of claim 1, wherein the cells are T cells.

3. The method of claim 1, wherein the first and second antigen binding molecules are chimeric antigen receptors (CARs).

4. The method of claim 3, wherein the CARs comprise an extracellular domain, a transmembrane domain, and an intracellular domain.

5. The method of claim 4, wherein the intracellular domain comprises a co-stimulatory domain comprising an intracellular domain of CD27, CD28, 4-1BB, OX40, CD30, CD40, PD-1, ICOS, lymphocyte function-associated antigen-1 (LFA-1), CD2, CD7, LIGHT, NKG2C, B7-H3, or a combination thereof.

6. The method of claim 4, wherein the intracellular domain comprises a CD3 zeta signaling domain.

7. The method of claim 1, wherein the first antigen comprises CD19, CD22, CD20, BCMA, CD5, CD7, CD2, CD16, CD56, CD30, CD14, CD68, CD11b, CD18, CD169, CD1c, CD33, CD38, CD138, or CD13.

8. The method of claim 1, wherein the first antigen comprises CD19, CD22, CD20, or BCMA.

9. The method of claim 1, wherein the first antigen binding molecule comprises amino acid sequence SEQ ID NO: 5.

10. The method of claim 8, wherein the second antigen comprises tMUC1, PRLR, CLCA1, MUC12, GUCY2C, GPR35, CR1L, MUC17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, QRFPR, GPR119, CLDN6, UPK2, ADAM12, SLC45A3, ACPP, MUC16, MS4A12, ALPP, CEA, EphA2, FAP, GPC3, IL13-Ra2, Mesothelin, PSMA, ROR1, VEGFR-II, GD2, FR-α, ErbB2, EpCAM, EGFRvIII, CLDN18.2, or EGFR.

11. The method of claim 9, wherein the second antigen binding molecule comprises amino acid sequence SEQ ID NO: 70, 8, or 11.

12. The method of claim 1, wherein the mixed population of modified cells comprises a dominant negative variant of a receptor of programmed death 1 (PD-1), cytotoxic T lymphocyte antigen-4 (CTLA-4), B- and T-lymphocyte attenuator (BTLA), T cell immunoglobulin mucin-3 (TIM-3), lymphocyte-activation protein 3 (LAG-3), T cell immunoreceptor with Ig and ITIM domains (TIGIT), leukocyte-associated immunoglobulin-like receptor 1 (LAIR1), natural killer cell receptor 2B4 (2B4), or CD160.

13. The method of claim 1, wherein the first binding molecule is a CAR, and the second binding molecule is a modified TCR.

14. The method of claim 1, wherein the mixed population of modified cells comprises a polynucleotide encoding a therapeutic agent comprising IL12, IL6, and/or IFNγ.

15. The method of claim 1, wherein the first and second vectors comprise lentiviral vectors.

16. A composition comprising a mixed population of modified cells, wherein the mixed population of modified cells comprises (i) modified cells comprising a first vector comprising a polynucleotide encoding a first antigen binding molecule that binds a first antigen and does not include polynucleotide encoding a second antigen binding molecule; (ii) modified cells comprising a second vector comprising a polynucleotide encoding a second antigen binding molecule that binds a second antigen and does not include polynucleotide encoding a first antigen binding molecule; and (iii) modified cells comprising the first vector and the second vector;

wherein the first antigen binding molecule binds a cell surface molecule of a B cell and the second antigen binding molecule binds a solid tumor antigen, and wherein the modified cells are T cells, natural killer (NK) cells, or dendritic cells; and wherein the modified cells are obtained by transducing cells with the first vector at a MOI of about 2 to about 15 and a second vector at a MOI of about 30 to 92 to obtain a mixed population of modified cells.

17. The composition of claim 16, wherein the first and second antigen binding molecules comprise CARs.

18. The composition of claim 17, wherein the CARs comprise an extracellular domain, a transmembrane domain, and an intracellular domain.

19. The composition of claim 18, wherein the intracellular domain comprises a co-stimulatory domain comprising an intracellular domain of CD27, CD28, 4-1BB, OX40, CD30, CD40, PD-1, ICOS, lymphocyte function-associated antigen-1 (LFA-1), CD2, CD7, LIGHT, NKG2C, B7-H3, or a combination thereof.

20. The composition of claim 18, wherein the intracellular domain comprises a CD3 zeta signaling domain.

21. The composition of claim 16, wherein the first antigen comprises CD19, CD22, CD20, BCMA, CD5, CD7, CD2, CD16, CD56, CD30, CD14, CD68, CD11b, CD18, CD169, CD1c, CD33, CD38, CD138, or CD13.

22. The composition of claim 16, wherein the first antigen comprises CD19, CD22, CD20, or BCMA.

23. The composition of claim 16, wherein the first antigen binding molecule comprises amino acid sequence SEQ ID NO: 5.

24. The composition of claim 16, wherein the second antigen comprises tMUC1, PRLR, CLCA1, MUC12, GUCY2C, GPR35, CR1L, MUC17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, QRFPR, GPR119, CLDN6, UPK2, ADAM12, SLC45A3, ACPP, MUC16, MS4A12, ALPP, CEA, EphA2, FAP, GPC3, IL13-Ra2, Mesothelin, PSMA, ROR1, VEGFR-II, GD2, FR-α, ErbB2, EpCAM, EGFRvIII, CLDN18.2, or EGFR.

25. The composition of claim 16, wherein the second antigen binding molecule comprises amino acid sequence SEQ ID NO: 70, 8, or 11.

26. The composition of claim 16, wherein the mixed population of modified cells comprises a dominant negative variant of a receptor of programmed death 1 (PD-1), cytotoxic T lymphocyte antigen-4 (CTLA-4), B- and T-lymphocyte attenuator (BTLA), T cell immunoglobulin mucin-3 (TIM-3), lymphocyte-activation protein 3 (LAG-3), T cell immunoreceptor with Ig and ITIM domains (TIGIT), leukocyte-associated immunoglobulin-like receptor 1 (LAIR1), natural killer cell receptor 2B4 (2B4), or CD160.

27. The composition of claim 16, wherein the first binding molecule is a CAR, and the second binding molecule is a modified TCR.

28. The composition of claim 16, wherein the mixed population of modified cells comprises a polynucleotide encoding a therapeutic agent comprising IL12, IL6, and/or IFNγ.

29. The composition of claim 16, wherein the first and second vectors comprise lentiviral vectors.

30. The composition of claim 16, wherein the modified cells are T cells.

31. The composition of claim 16, wherein the composition is a pharmaceutical composition.

* * * * *